US009333244B2

(12) United States Patent
Li et al.

(10) Patent No.: US 9,333,244 B2
(45) Date of Patent: May 10, 2016

(54) COMPOSITION AND LIPID FORMULATION OF A HYALURONAN-DEGRADING ENZYME AND THE USE THEREOF FOR TREATMENT OF BENIGN PROSTATIC HYPERPLASIA

(71) Applicants: Xiaoming Li, San Diego, CA (US); Mysore Ramprasad, San Diego, CA (US); Curtis Thompson, Encinitas, CA (US); Harold Michael Shepard, San Diego, CA (US); Louis Howard Bookbinder, San Diego, CA (US); Gregory Ian Frost, Del Mar, CA (US)

(72) Inventors: Xiaoming Li, San Diego, CA (US); Mysore Ramprasad, San Diego, CA (US); Curtis Thompson, Encinitas, CA (US); Harold Michael Shepard, San Diego, CA (US); Louis Howard Bookbinder, San Diego, CA (US); Gregory Ian Frost, Del Mar, CA (US)

(73) Assignee: Halozyme, Inc., San Diego, CA (US)

( * ) Notice: Subject to any disclaimer, the term of this patent is extended or adjusted under 35 U.S.C. 154(b) by 391 days.

(21) Appl. No.: 13/815,311

(22) Filed: Feb. 19, 2013

(65) Prior Publication Data
US 2013/0251786 A1 Sep. 26, 2013

Related U.S. Application Data

(63) Continuation of application No. PCT/US2012/024376, filed on Feb. 8, 2012.

(60) Provisional application No. 61/462,875, filed on Feb. 8, 2011.

(51) Int. Cl.
*A61K 38/00* (2006.01)
*A61K 38/47* (2006.01)
*A61K 9/00* (2006.01)
*A61K 9/127* (2006.01)

(52) U.S. Cl.
CPC .............. *A61K 38/47* (2013.01); *A61K 9/0034* (2013.01); *A61K 9/127* (2013.01)

(58) Field of Classification Search
None
See application file for complete search history.

(56) References Cited

U.S. PATENT DOCUMENTS

| 3,539,794 | A | 11/1970 | Zaffaroni | 240/2.25 |
|---|---|---|---|---|
| 3,710,795 | A | 1/1973 | Higuchi et al. | 424/424 |
| 3,875,229 | A | 4/1975 | Gold | 260/562 |
| 4,002,531 | A | 1/1977 | Royer | 435/188 |
| 4,078,052 | A | 3/1978 | Papahadjopoulos | 424/36 |
| 4,097,578 | A | 6/1978 | Perronnet et al. | 424/273 |
| 4,179,337 | A | 12/1979 | Davis et al. | 435/181 |
| 4,202,314 | A | 5/1980 | Smirnnnov et al. | 128/218 |
| 4,214,584 | A | 7/1980 | Smirnnnov et al. | 128/218 |
| 4,220,735 | A | 9/1980 | Diek et al. | 525/90 |
| 4,224,179 | A | 9/1980 | Schneider | 252/316 |
| 4,235,871 | A | 11/1980 | Papahadjopoulos et al. | 424/19 |
| 4,239,776 | A | 12/1980 | Glen | 424/304 |
| 4,308,166 | A | 12/1981 | Marchetti et al. | 252/316 |
| 4,310,506 | A | 1/1982 | Baldeschwieler et al. | 424/1 |
| 4,377,584 | A | 3/1983 | Rasmusson | 424/244 |
| 4,386,080 | A | 5/1983 | Crossley et al. | 424/209 |
| 4,394,372 | A | 7/1983 | Taylor | 424/178 |
| 4,485,054 | A | 11/1984 | Mezei et al. | 264/4.6 |
| 4,508,703 | A | 4/1985 | Redziniak et al. | 264/4.6 |
| 4,522,803 | A | 6/1985 | Lenk et al. | 264/4.6 |
| 4,529,403 | A | 7/1985 | Kamstra | 604/136 |
| 4,636,505 | A | 1/1987 | Tucker | 514/256 |
| 4,760,071 | A | 7/1988 | Rasmusson et al. | 514/284 |
| 4,859,681 | A | 8/1989 | Rasmusson et al. | 514/284 |
| 4,952,496 | A | 8/1990 | Studier et al. | 435/91.41 |
| 4,983,164 | A | 1/1991 | Hook et al. | 604/139 |
| 5,033,252 | A | 7/1991 | Carter | 53/425 |
| 5,041,292 | A | 8/1991 | Feijen | 424/484 |
| 5,052,558 | A | 10/1991 | Carter | 206/439 |
| 5,116,615 | A | 5/1992 | Gokcen et al. | 424/94.2 |
| 5,122,614 | A | 6/1992 | Zalipsky | 548/520 |
| 5,171,081 | A | 12/1992 | Pita et al. | 362/101 |
| 5,323,907 | A | 6/1994 | Kalvelage | 206/531 |
| 5,324,844 | A | 6/1994 | Zalipsky | 548/520 |
| 5,395,326 | A | 3/1995 | Haber et al. | 604/191 |
| 5,446,090 | A | 8/1995 | Harris | 525/54.1 |
| 5,612,460 | A | 3/1997 | Zalipsky | 530/391.9 |
| 5,631,018 | A | 5/1997 | Zalipsky et al. | 424/450 |
| 5,643,575 | A | 7/1997 | Martinez et al. | 424/194.1 |
| 5,672,662 | A | 9/1997 | Harris et al. | 525/408 |
| 5,696,077 | A | 12/1997 | Johnson et al. | 424/184.1 |
| 5,714,166 | A | 2/1998 | Tomalia et al. | 424/486 |
| 5,723,147 | A | 3/1998 | Kim et al. | 424/450 |

(Continued)

FOREIGN PATENT DOCUMENTS

DE 10024752 11/2001
EP 0822199 9/2004

(Continued)

OTHER PUBLICATIONS

Aaltomaa et al., "Strong stromal hyaluronan expression is associated with PSA recurrence in local prostate cancer," Urol Int 69:266-272 (2002).

(Continued)

*Primary Examiner* — Anand Desai
(74) *Attorney, Agent, or Firm* — Dentons US LLP; Stephanie Seidman

(57) ABSTRACT

Provided are compositions and formulations or co-formulations containing a hyaluronan degrading enzyme. The compositions, formulations or co-formulations can also contain another therapeutic agent, such as one that is suitable for treatment of Benign Prostatic Hyperplasia, for example, a 5-alpha reductase inhibitor. The compositions and formulations can be used for the treatment of Benign Prostatic Hyperplasia. The compositions and formulations can be provided in combinations with one or more other agents for the treatment of Benign Prostatic Hyperplasia.

72 Claims, No Drawings

(56) References Cited

U.S. PATENT DOCUMENTS

| | | | |
|---|---|---|---|
| 5,747,027 A | 5/1998 | Stern et al. | 424/94.62 |
| 5,753,641 A | 5/1998 | Gormley et al. | 514/179 |
| 5,766,581 A | 6/1998 | Bartley et al. | 424/85.1 |
| 5,766,627 A | 6/1998 | Sankaram et al. | 424/450 |
| 5,788,670 A | 8/1998 | Reinnnhard et al. | 604/191 |
| 5,795,569 A | 8/1998 | Bartley et al. | 424/85.1 |
| 5,808,096 A | 9/1998 | Zalipsky | 548/520 |
| 5,827,721 A | 10/1998 | stern et al. | 435/201 |
| 5,837,265 A | 11/1998 | Montal et al. | 424/239.1 |
| 5,872,150 A | 2/1999 | Elbrecht | 424/325 |
| 5,891,467 A | 4/1999 | Willis | 424/417 |
| 5,900,461 A | 5/1999 | Harris | 525/54.11 |
| 5,919,455 A | 7/1999 | Greennnwald et al. | 424/178.1 |
| 5,919,665 A | 7/1999 | Williams | 435/252.3 |
| 5,932,462 A | 8/1999 | Harris et al. | 435/188 |
| 5,939,070 A | 8/1999 | Johnson et al. | 424/194.1 |
| 5,955,368 A | 9/1999 | Johnson et al. | 435/252.3 |
| 5,962,016 A | 10/1999 | Willis | 424/450 |
| 5,971,953 A | 10/1999 | Bachynnnsky | 604/181 |
| 5,985,263 A | 11/1999 | Lee et al. | 424/85.2 |
| 5,989,545 A | 11/1999 | Foster et al. | 424/183.1 |
| 5,990,237 A | 11/1999 | Bentley et al. | 525/54.2 |
| 5,994,362 A | 11/1999 | Gormley et al. | 514/284 |
| 6,054,569 A | 4/2000 | Benett et al. | 424/945 |
| 6,106,858 A | 8/2000 | Ye et al. | 264/4.1 |
| 6,113,906 A | 9/2000 | Greenwald et al. | 424/194.1 |
| 6,129,761 A | 10/2000 | Hubbell | 424/426 |
| 6,200,573 B1 | 3/2001 | Locke | 424/195.1 |
| 6,214,966 B1 | 4/2001 | Harris | 528/322 |
| 6,241,999 B1 | 6/2001 | Ye et al. | 264/4.1 |
| 6,258,351 B1 | 7/2001 | Harris | 424/78.3 |
| 6,296,847 B1 | 10/2001 | Gokcen et al. | 424/94.2 |
| 6,306,423 B1 | 10/2001 | Donovan et al. | 424/236.1 |
| 6,306,432 B1 | 10/2001 | Shirley et al. | 264/4.1 |
| 6,312,708 B1 | 11/2001 | Donovan | 424/184.1 |
| 6,340,742 B1 | 1/2002 | Burg et al. | 530/351 |
| 6,383,509 B1 | 5/2002 | Donovan et al. | 424/236.1 |
| 6,413,507 B1 | 7/2002 | Bentley et al. | 424/78 |
| 6,420,339 B1 | 7/2002 | Gegg et al. | 514/12 |
| 6,428,785 B1 | 8/2002 | Gokcen | 424/94.2 |
| 6,437,025 B1 | 8/2002 | Harris et al. | 523/406 |
| 6,448,369 B1 | 9/2002 | Bentley et al. | 528/425 |
| 6,461,617 B1 | 10/2002 | Shone et al. | 424/157.1 |
| 6,461,802 B1 | 10/2002 | Van Thillo et al. | 430/336 |
| 6,495,659 B2 | 12/2002 | Bentley et al. | 528/425 |
| 6,506,399 B2 | 1/2003 | Donovan | 424/184.1 |
| 6,585,993 B2 | 7/2003 | Donovan et al. | 424/236.1 |
| 6,692,468 B1 | 2/2004 | Waldenburg | 604/191 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 6,913,744 B2 | 7/2005 | Gokcen | 424/94.1 |
| 6,972,005 B2 | 12/2005 | Boehum et al. | 222/135 |
| 7,015,253 B2 | 3/2006 | Escandon et al. | 514/724 |
| 7,041,792 B2 | 5/2006 | Elmore et al. | 424/184.1 |
| 7,148,041 B2 | 12/2006 | Donovan | 424/236.1 |
| 7,153,514 B2 | 12/2006 | Schmidt | 424/236.1 |
| 7,189,541 B2 | 3/2007 | Donovan | 424/236.1 |
| 7,223,577 B2 | 5/2007 | Steward | 435/183 |
| 7,262,291 B2 | 8/2007 | Donovan | 424/236.1 |
| 7,445,914 B2 | 11/2008 | Donovan | 424/236.1 |
| 7,449,192 B2 | 11/2008 | Schmidt | 424/234.1 |
| 7,452,697 B2 | 11/2008 | Luo et al. | 424/236.1 |
| 7,455,845 B2 | 11/2008 | Schmidt et al. | 424/234.1 |
| 7,465,457 B2 | 12/2008 | Johnson et al. | 424/190.1 |
| 7,491,403 B2 | 2/2009 | Borodic | 424/184.1 |
| 7,491,799 B2 | 2/2009 | Steward et al. | 530/350 |
| 7,556,817 B2 | 7/2009 | Steward et al. | 424/239.1 |
| 7,579,010 B2 | 8/2009 | Hunt | 424/184.1 |
| 7,767,429 B2 | 8/2010 | Frost et al. | 435/201 |
| 7,829,081 B2 | 11/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 7,914,542 B2 | 3/2011 | Lamson et al. | 606/139 |
| 8,105,586 B2 | 1/2012 | Bookbinder et al. | 424/94.3 |
| 8,187,855 B2 | 5/2012 | Baker et al. | 435/201 |
| 8,202,517 B2 | 6/2012 | Bookbinder et al. | 424/94.62 |
| 8,257,699 B2 | 9/2012 | Bookbinder et al. | 424/94.62 |
| 8,343,487 B2 | 1/2013 | Baker et al. | 424/94.62 |
| 8,431,124 B2 | 4/2013 | Bookbinder et al. | 424/94.62 |
| 8,431,380 B2 | 4/2013 | Bookbinder et al. | 435/201 |
| 8,450,470 B2 | 5/2013 | Bookbinder et al. | 536/23.2 |
| 8,765,685 B2 | 7/2014 | Bookbinder et al. | 514/20.9 |
| 8,772,246 B2 | 7/2014 | Bookbinder et al. | 435/200 |
| 2001/0021763 A1 | 9/2001 | Harris | 528/75 |
| 2001/0044526 A1 | 11/2001 | Shen | 530/409 |
| 2002/0156047 A1 | 10/2002 | Zhao | 514/58 |
| 2002/0185139 A1 | 12/2002 | Soll et al. | 128/898 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0220447 A1 | 11/2003 | Harris | 528/322 |
| 2004/0013637 A1 | 1/2004 | Bentley et al. | 424/78.17 |
| 2004/0081659 A1 | 4/2004 | Brady et al. | 424/185.1 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.62 |
| 2005/0287180 A1 | 12/2005 | Chen | 424/400 |
| 2006/0104968 A1 | 5/2006 | Bookbinder et al. | 424/94.62 |
| 2006/0228404 A1 | 10/2006 | Anderson et al. | 424/450 |
| 2007/0235889 A1 | 10/2007 | Hartounian et al. | 264/4.1 |
| 2008/0145415 A1 | 6/2008 | Callegaro et al. | 424/450 |
| 2008/0199452 A1 | 8/2008 | Gaylis et al. | 424/94.6 |
| 2008/0199453 A1 | 8/2008 | Gaylis et al. | 424/94.6 |
| 2009/0018523 A1 | 1/2009 | Lamson et al. | 604/56 |
| 2009/0123367 A1 | 5/2009 | Bookbinder et al. | 424/1.49 |
| 2009/0214685 A1 | 8/2009 | Hunt | 424/780 |
| 2009/0253175 A1 | 10/2009 | Bookbinder et al. | 435/69.1 |
| 2010/0003238 A1 | 1/2010 | Frost et al. | 424/94.62 |
| 2010/0143457 A1 | 6/2010 | Wei et al. | 424/450 |
| 2010/0305500 A1 | 12/2010 | Lambert et al. | 604/82 |
| 2011/0152359 A1 | 6/2011 | Bookbinder et al. | 435/200 |
| 2011/0212074 A1 | 9/2011 | Frost et al. | 424/85.1 |
| 2012/0020951 A1 | 1/2012 | Shepard et al. | 424/130.1 |
| 2012/0093770 A1 | 4/2012 | Bookbinder et al. | 424/94.62 |
| 2012/0148555 A1 | 6/2012 | Bookbinder et al. | 435/200 |
| 2012/0171153 A1 | 7/2012 | Frost et al. | 424/94.62 |
| 2012/0196348 A1 | 8/2012 | Baker et al. | 424/94.62 |
| 2012/0213767 A1 | 8/2012 | Wei et al. | 424/450 |
| 2012/0251620 A1 | 10/2012 | Bookbinder et al. | 424/450 |
| 2012/0294830 A1 | 11/2012 | Bookbinder et al. | 424/85.2 |
| 2013/0058893 A1 | 3/2013 | Bookbinder et al. | 435/200 |
| 2014/0037613 A1 | 2/2014 | Bookbinder et al. | 424/94.62 |
| 2014/0199282 A1 | 7/2014 | Bookbinder et al. | 435/200 |
| 2015/0196623 A9 | 7/2015 | Bookbinder et al. | 424/94.62 |

FOREIGN PATENT DOCUMENTS

| | | |
|---|---|---|
| EP | 1064951 | 8/2007 |
| JP | A-H04-503071 | 6/1992 |
| JP | A-H10-508205 | 8/1998 |
| JP | A-2010-519211 | 6/2010 |
| WO | WO 90/08555 | 8/1990 |
| WO | WO 92/16640 | 10/1992 |
| WO | WO 94/28024 | 12/1994 |
| WO | WO 94/15848 | 3/1996 |
| WO | WO 96/34093 | 10/1996 |
| WO | WO 98/07408 | 2/1998 |
| WO | WO 00/02017 | 1/2000 |
| WO | WO 01/87925 | 4/2001 |
| WO | WO 02/49673 | 6/2002 |
| WO | WO 02/096368 | 12/2002 |
| WO | WO 03/005889 | 1/2003 |
| WO | WO 01/47584 | 9/2004 |
| WO | WO 2005/000360 | 1/2005 |
| WO | WO 2006/133553 | 12/2006 |
| WO | WO 2007/006030 | 1/2007 |
| WO | WO 2008/101098 | 8/2008 |
| WO | WO 2009/111066 | 9/2009 |

(56) References Cited

FOREIGN PATENT DOCUMENTS

| WO | WO 2010/077297 | 7/2010 |
|---|---|---|
| WO | WO 2011/075623 | 6/2011 |
| WO | WO 2012/109387 | 8/2012 |

OTHER PUBLICATIONS

Adams et al., "The c-myc oncogene driven by immunoglobulin enhancers induces lymphoid malignancy in transgenic mice," Nature 318:533-538 (1985).
Alexander et al., "Expression of the c-myc oncogene under control of an immunoglobulin enhancer in E mu-myc transgenic mice," Mol. Cell Biol. 7:1436-1444 (1987).
Alonso-Magdalena et al., "A role for epithelial-mesenchymal transition in the etiology of benign prostatic hyperplasia," Proc Natl Acad Sci USA 106:2859-2863 (2009).
Altschul, S., "Basic local alignment search tool," J Molec Biol 215(3):403-410 (1990).
Anderson, R. and F. Wu, "Comparison between testosterone enanthate-induced azoospermia and oligozoospermia in a male contraceptive study. II. Pharmacokinetics and pharmacodynamics of once weekly administration of testosterone enanthate," J Clin Endocrinol Metab., 81(3):896-901 (1996).
Ansel, H., Introduction to Pharmaceutical Dosage Forms, Fourth Edition, Lea & Febiger:Philadelphia, p. 126 (1985).
Arming et al., "In vitro mutagenesis of PH-20 hyaluronidase from human sperm," Eur J Biochem 247(3):810-814 (1997).
Battmann et al., "Pharmacological profile of RU 58642, a potent systemic antiandrogen for the treatment of androgen-dependent disorders," J. Steroid Biochem. Mol. Biol. 64:103-111 (1998).
Benhir et al., "Pseudomonas exotoxin A mutants. Replacement of surface-exposed residues in domain III with cysteine residues that can be modified with polyethylene glycol in a site-specific manner," J. Biol. Chem. 269:13398-13404 (1994).
Bianchi et al., "Synthetic depsipeptide substrates for the assay of human hepatitis C virus protease," Anal. Biochem. 237:239-244 (1996).
Black et al., "An examination of treatment patterns and costs and care among patients with benign prostatic hyperplasia," Am J Manag Care 12:S99-S110 (2006).
Bordier C., "Phase separation of integral membrane proteins in Triton X-114 solution," J Biol Chem. 256(4):1604-1607 (1981).
Bouffard et al., "An in vitro assay for hepatitis C virus NS3 serine proteinase," Virology 209:52-59 (1995).
Brinster et al., "Regulation of metallothionein—thymidine kinase fusion plasmids injected into mouse eggs," Nature 296:39-42 (1982).
Brumeanu et al., "Derivatization with monomethoxypolyethylene glycol of Igs expressing viral epitopes obviates adjuvant requirements," J Immunol. 154:3088-3095 (1995).
Buckley et al., "Characterization and immunohistochemical localization of the glycoconjugates of the rabbit bladder mucosa," Arch Biochem Biophys. Jun. 1, 1996;330(1):163-173.
Caliceti, P. and F. Veronese, "Pharmacokinetic and biodistribution properties of poly(ethylene glycol)-protein conjugates," Adv. Drug Deliv. Rev. 55(10):1261-1277 (2003).
Carrillo, H. and D. Lipman, "The multiple-sequence alignment problem in biology," SIAM J Applied Math 48:1073-1082 (1988).
Chapman et al., "Therapeutic antibody fragments with prolonged in vivo half-lives," Nature Biotech. 17:780-783 (1999).
Cheng et al., "PEGylated adenoviruses for gene delivery to the intestinal epithelium by the oral route," Pharm. Res. 20(9):1444-1451 (2003).
Cherr et al., "The dual functions of GPI-anchored PH-20: hyaluronidase and intracellular signaling," Matrix Biol. 20:515-525 (2001).
Cho et al., "Construction of hepatitis C-SIN virus recombinants with replicative dependency on hepatitis C virus serine protease activity," J. Virol. Meth. (65):201-207 (1997).
Chuang et al., "The potential and promise of using botulinum toxin in the prostate gland," BJU Int. 98(1):28-32 (2006).
Claus et al., "Immunohistochemical determination of age related proliferation rates in normal and benign hyperplastic human prostates," Urol Res. 21(5):305-308 (1993).
Danilkovitch-Miagkova et al., "Hyaluronidase 2 negatively regulates RON receptor tyrosine kinase and mediates transformation of epithelial cells by jaagsiekte sheep retrovirus," Proc Natl Acad Sci USA. 100(8):4580-4585 (2003).
Davies et al., "Radiation improves the distribution and uptake of liposomal doxorubicin (caelyx) in human osteosarcoma xenograph," Cancer Research, 64:547-553 (2004).
DeBoer et al., "The tac promoter: a functional hybrid derived from the trp and lac promoters," Proc. Natl. Acad. Sci. USA 80:21-25 (1983).
Delpech et al., "Enzyme-linked hyaluronectin: a unique reagent for hyaluronan assay and tissue location and for hyaluronidase activity detection," Anal. Biochem. 229:35-41 (1995).
Devereux et al, "A comprehensive set of sequence analysis programs for the VAX," Nucleic Acids Research 12:387-395 (1984).
di Salle et al., "PNU 157706, a novel dual type I and II 5alpha-reductase inhibitor," J Steroid Biochem. Mol. Biol. 64(3-4):179-186 (1998).
Ditrolio et al., "Chemo-ablation of the prostate with dehydrated alcohol for the treatment of prostatic obstruction," J Urol., 167(5):2100-2104 (2002).
D'Souza et al., "In vitro cleavage of hepatitis C virus polyprotein substrates by purified recombinant NS3 protease," J. Gen. Virol. 76:1729-1736 (1995).
Dutkiewicz, S., "Usefulness of Cernilton in the treatment of benign prostatic hyperplasia," Int Urol Nephrol. 28(1):49-53 (1996).
Eikenes et al., "Hyaluronidase induces a transcapillary pressure gradient and improves the distribution and uptake of liposomal doxorubicin (Caelyx) in human osteosarcoma xenografts," British Journal of Cancer 93:81-88 (2005).
Eisenhaber et al., "Prediction of potential GPI-modification sites in proprotein sequences," J. Mol. Biol. 292(3):741-758 (1999).
Ernst et al., "Enzymatic degradation of glycosaminoglycans," Critical Reviews in Biochemistry and Molecular Biology 30(5):387-444 (1995).
Fankhauser, N. and P.Mäser, "Identification of GPI anchor attachment signals by a Kohonen self-organizing map," Bioinformatics 21(9):1846-1852 (2005).
Felix et al., "Pegylated peptides. IV. Enhanced biological activity of site-directed pegylated GRF analogs," Int. J. Peptide Res. 46:253-264 (1995).
Filocamo et al., "Chimeric Sindbis viruses dependent on the NS3 protease of hepatitis C virus," J.Virology 71:1417-1427 (1997).
Fletcher et al., "Antinociceptive effect of bupivacaine encapsulated in poly(D,L)-lactide-co-glycolide microspheres in the acute inflammatory pain model of carrageenin-injected rats," Anesth. Analg. 84:90-94 (1997).
Frost et al., "Purification, cloning, and expression of human plasma hyaluronidase," Biochem. Biophys. Res. Commun. 236(1):10-15 (1997).
Frost, G. and R. Stern, "A microtiter-based assay for hyaluronidase activity not requiring specialized reagents," Anal. Biochem. 251:263-269 (1997).
Frost, G., "Recombinant human hyaluronidase (rHuPH20): an enabling platform for subcutaneous drug and fluid administration," Expert Opin. Drug. Deliv. 4:427-440 (2007).
Gabizon et al., "Pharmacokinetics of pegylated liposomal Doxorubicin: review of animal and human studies," Clin Pharmacokinet 42:419-436 (2003).
Gakunga et al., "Hyaluronan is a preprequisite for ductal branching morphogenesis," Development 124:3987-3997 (1997).
Gardner et al., "The complete nucleotide sequence of an infectious clone of cauliflower mosaic virus by M13mp7 shotgun sequencing," Nucleic Acids Res. 9:2871-2888 (1981).
Gilbert, W. and L. Villa-Komaroff, "Useful proteins from recombinant bacteria," Scientific American 242(4):74-94 (1980).
Gormley et al., "The effect of finasteride in men with benign prostatic hyperplasia," New England Journal of Medicine 327:1185-1191 (1992).

(56) References Cited

OTHER PUBLICATIONS

Goya et al., "Local injection of a sustained-release antiandrogen formulation into a target prostatic site: an experimental study," BJU International 99:202-206 (2007).

Gribskov et al., "Sigma factors from E. coli, B. subtilis, phage SP01, and phage T4 are homologous proteins," Nucl. Acids Res. 14(16):6745-6763 (1986).

Grise et al., "Evaluation of the transurethral ethanol ablation of the prostate (TEAP) for symptomatic benign prostatic hyperplasia (BPH): a European multi-center evaluation," Eur. Urol., 46(4):496-501 (2004).

Grosschedl et al., "Introduction of a mu immunoglobulin gene into the mouse germ line: specific expression in lymphoid cells and synthesis of functional antibody," Cell 38:647-658 (1984).

Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).

Hahm et al., "Generation of a novel poliovirus with a requirement of hepatitis C virus protease NS3 activity," Virology 226:318-326 (1996).

Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).

Hamatake et al., "Establishment of an in vitro assay to characterize hepatitis C virus NS3-4A protease trans-processing activity ," Intervirology 39:249-258 (1996).

Hammer et al., "Diversity of alpha-fetoprotein gene expression in mice is generated by a combination of separate enhancer elements," Science 235:53-58 (1987).

Hanahan, D., "Heritable formation of pancreatic beta-cell tumours in transgenic mice expressing recombinant insulin/simian virus 40 oncogenes," Nature 315(6015):115-122 (1985).

Harmon et al., "Transurethral enzymatic ablation of the prostate: canine model," Urology 48:229-233 (1996).

Harris, J. and R. Chess, "Effect of pegylation on pharmaceuticals," Nat Rev Drug Discov 2(3):214-221 (2003).

Herrera-Estrella et al., "Expression of chimaeric genes transferred into plant cells using a ti-plasmid-derived vector," Nature 303:209-213 (1984).

Herrera-Estrella et al., "Light-inducible and chloroplast-associated expression of a chimaeric gene introduced into Nicotiana tabacum using a Ti plasmid vector," Nature 310(5973):115-120 (1984).

Hibi et al., "Chondroitinase C activity of Streptococcus intermedius," FEMS-Microbiol-Lett. 48(2):121-124 (1989).

Hovingh et al., "Hyaluronidase activity in leeches (Hirudinea)," (1999) Comp Biochem Physiol B Biochem Mol Biol. 124(3):319-326.

Howell et al., "Clinical applications of a novel sustained-release injectable drug delivery system: DepoFoam technology" Cancer Journal 7:219-227 (2001).

Ito et al., "Cultivation of hepatitis C virus in primary hepatocyte culture from patients with chronic hepatitis C results in release of high titre, infectious virus," J. Gen. Virol. 77:1043-1054 (1996).

IUPAC-IUB Commission on Biochemical Nomenclature, "A One-Letter Notation for Amino Acid Sequences: Tentative Rules," J. Biol. Chem. 243:3557-3559 (1968).

IUPAC-IUB, "Abbreviated nomenclature of synthetic poypeptides-polymerized amino acids-revised recommendations," Commission on Biochemical Nomenclature, Biochemistry 11:1726-1731 (1972).

Jay et al., "Construction of a general vector for efficient expression of mammalian proteins in bacteria: use of a synthetic ribosome binding site," Proc. Natl. Acad. Sci. USA 78:5543-5548 (1981).

Kelsey et al., "Species- and tissue-specific expression of human alpha 1-antitrypsin in transgenic mice," Genes and Devel. 1:161-171 (1987).

Kollias et al., "Regulated expression of human A gamma-, beta-, and hybrid gamma beta-globin genes in transgenic mice: manipulation of the developmental expression patterns," Cell 46:89-94 (1986).

Krumlauf et al., Developmental regulation of alpha-fetoprotein genes in transgenic mice, Mol. Cell. Biol. 5:1639-1648 (1985).

Kuo et al., "Therapeutic effects of add-on botulinum toxin A on patients with large benign prostatic hyperplasia and unsatisfactory response to combined medical therapy," Scand J Urol Nephrol. 43(3):206-211 (2009).

Lalancette et al, "Characterization of an 80-kilodalton bull sperm protein identified as PH-20," Biol Reprod. 65(2):628-636 (2001).

Lam et al., "Long-term treatment with finasteride in men with symptomatic benign prostatic hyperplasia: 10-year follow-up," Urology, 61(2):354-358 (2003).

Langston et al., "Modulation of the sustained delivery of myelopoietin (Leridistim) encapsulated in multivesicular liposomes (DepoFoam)," J Control Release. 89(1):87-99 (2003).

Leder et al., "Consequences of widespread deregulation of the c-myc gene in transgenic mice: multiple neoplasms and normal development," Cell 45:485-495 (1986).

Lokeshwar et al., "Stromal and epithelial expression of tumor markers hualuronic acid and HYAL1 hyaluronidase in prostate cancer," J Biol Chem 276:11922-11932 (2001).

Lu, H. and E. Wimmer., "Poliovirus chimeras replicating under the translational control of genetic elements of hepatitis C virus reveal unusual properties of the internal ribosomal entry site of hepatitis C virus," Proc. Natl. Acad. Sci. USA 93:1412-1417 (1996).

Lu, Y. and A. Felix, "Pegylated peptides I: Solid-phase synthesis of N alpha-pegylated peptides using Fmoc strategy," Peptide Res 6:140-146 (1993).

Lu, Y. and A. Felix, "Pegylated peptides. II. Solid-phase synthesis of amino-, carboxy- and side-chain pegylated peptides," Int. J. Peptide Protein Res. 43:127-138 (1994).

MacDonald, R., "Expression of the pancreatic elastase I gene in transgenic mice," Hepatology 7:42S-51S(1987).

Magram et al., "Developmental regulation of a cloned adult beta-globin gene in transgenic mice," Nature 315:338-340 (1985).

Mahapokai et al., "Models for studying benign prostatic hyperplasia," Prostate Cancer and Prostatic Diseases 3:28-33 (2000).

Mason et al., "The hypogonadal mouse: reproductive functions restored by gene therapy," Science 234:1372-1378 (1986).

Megeed et al., "Controlled release of plasmid DNA from a genetically engineered silk-elastinlike hydrogel," Pharm Res. 19(7):954-959 (2002).

Mehvar, R., "Modulation of the pharmacokinetics and pharmacodynamics of proteins by polyethylene glycol conjugation," J. Pharm. Pharmaceut. Sci. 3(1):125-136 (2000).

Michelacci et al., "Chondroitinase C from Flavobacterium heparinum," J. Biol. Chem. 251:1154-1158 (1976).

Mizutani et al., Characterization of hepatitis C virus replication in cloned cells obtained from a human T-cell leukemia virus type 1-infected cell line, MT-2, J.Virol. 70:7219-7223 (1996).

Mizutani et al., "Inhibition of hepatitis C virus replication by antisense oligonucleotide in culture cells," Biochem. Biophys. Res. Commun. 212:906-911 (1995).

Mizutani et al., "Long-term human T-cell culture system supporting hepatitis C virus replication," Biochem. Biophys. Res. Commun. 227:822-826 (1996).

Molineux, G., "Pegylation: engineering improved biopharmaceuticals for oncology," Pharmacotherapy 23 (8 Pt 2):3S-8S (2003).

Monfardini et al, "A branched monomethoxypoly(ethylene glycol) for protein modification," Bioconjugate Chem. 6:62-69 (1995).

Nakayama et al., "FR146687, a novel steroid 5 alpha-reductase inhibitor: in vitro and in vivo effects on prostates," Prostate, 31(4):241-249 (1997).

Needleman, S. and C. Wunsch "A general method applicable to the search for similarities in the amino acid sequence of two proteins," J Mol Biol. 48:443-453 (1970).

Noguchi et al., "Clinical significance of interruption of therapy with allylestrenol in patients with benign prostatic hypertrophy," Int J Urol. 5(5):466-470 (1998).

Ohya, T., and Y. Kaneko, "Novel hyaluronidase from streptomyces," Biochim. Biophys. Acta 198:607-609 (1970).

(56) References Cited

OTHER PUBLICATIONS

Omaetxebarria et al., "Computational approach for identification and characterization of GPI-anchored peptides in proteomics experiments," Proteomics 7(12):1951-1960 (2007).

Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).

Pearson, W. and D. Lipman "Improved tools for biological sequence comparison," Proc. Natl. Acad. Sci. USA 85:2444 (1988).

Peppas et al., "Hydrogels in pharmaceutical formulations," Eur J Pharm Biopharm. 50(1):27-46 (2000).

Pepper et al., "CGMP manufacturing scale-up of a multivesicular lipid based drug delivery system," Pharm Eng. 19:8-18 (1999).

Pham et al., "Large-scale transient transfection of serum-free suspension-growing HEK293 EBNA1 cells: peptone additives improve cell growth and transfection efficiency," Biotechnology and Bioengineering 84:332-342 (2003).

Pierleoni et al., PredGPI: a GPI-anchor predictor, BMC Bioinformatics 9:392, 11 pages (2008).

Pinkert et al., "An albumin enhancer located 10 kb upstream functions along with its promoter to direct efficient, liver-specific expression in transgenic mice," Genes and Devel. 1:268-276 (1987).

Plante et al., "Diffusion properties of transurethral intraprostatic injection," BJU International 94:1384-1388 (2004).

Ramprasad et al., "Sustained-delivery of an apolipoprotein E-peptidomimetic using multivesicular liposomes lowers serum cholesterol levels," J Control Release. 79(1-3):207-218 (2002).

Ramprasad et al., "The sustained granulopoietic effect of progenipoietin encapsulated in multivesicular liposomes," Int J Pharmaceutics 261:93-103 (2003).

Readhead et al., "Expression of a myelin basic protein gene in transgenic shiverer mice: correction of the dysmyelinating phenotype," Cell 48:703-712 (1987).

Roberts et al., "Chemistry for peptide and protein PEGylation," Advanced Drug Delivery Review 54:459-476 (2002).

Saemi et al., "Injectables in the prostate," Current Opinion in Urology 18:28-33 (2008).

Saemi et al., "Injection therapy for prostatic disease: A renaissance concept," Indian J of Urology 329-335 (2008).

Sato et al., "Cloning and expression in *Escherichia coli* of the gene encoding the Proteus vulgaris chondroitin ABC lyase," Appl. Microbiol. Biotechnol. 41(1):39-46 (1994).

Sato, H., "Enzymatic procedure for site-specific pegylation of proteins," Adv. Drug Deliv. Rev. 54:487-504 (2002).

Schwartz and Dayhoff, eds., *Atlas of Protein Science and Structure*, National Biomedical Research Foundation, pp. 353-358 (1979).

Shani, M., "Tissue-specific expression of rat myosin light-chain," Nature 314:283-286 (1985).

Shimizu, Y. and H. Yoshikura, "Multicycle infection of hepatitis C virus in cell culture and inhibition by alpha and beta interferons," J. Virol. 68:8406-8408 (1994).

Smith et al., "Finasteride in the treatment of patients with benign prostatic hyperplasia: a review," Therapeutics and Clinical Risk Management 5:535-545 (2009).

Steinkuhler et al., "Product inhibition of the hepatitis C virus NS3 protease," Biochem. 37:8899-8905 (1998).

Sudo et al., "Establishment of an in vitro assay system for screening hepatitis C virus protease inhibitors using high performance liquid chromatography," Antiviral Res. 32:9-18 (1996).

Swift et al., "Tissue-specific expression of the rat pancreatic elastase 1 gene in transgenic mice," Cell 38(3):639-646 (1984).

Takahashi et al., "A fluorimetric Morgan-Elson assay method for hyaluronidase activity," Anal. Biochem. 322:257-263 (2003).

Takeshita et al., "An enzyme-linked immunosorbent assay for detecting proteolytic activity of hepatitis C virus proteinase," Anal. Biochem. 247:242-246 (1997).

Takezawa et al., "Effects of a new steroidal antiandrogen, TZP-4238 (17 alpha-acetoxy-6-chloro-2-oxa-4, 6-pregnadiene-3, 20-dione), on spontaneously developed canine benign prostatic hyperplasia," Prostate 27:321-328 (1993).

Takezawa et al., "Effects of the new steroidal antiandrogen TZP-4238 on hormone-induced canine prostatic hyperplasia," Prostate 21(4):315-329 (1992).

Taliani et al., "A continuous assay of hepatitis C virus protease based on resonance energy transfer depsipeptide substrates," Anal. Biochem. 240:60-67 (1996).

Thompson et al., "Enzymatic depletion of tumor hyaluronan induces antitumor responses in preclinical animal models," Molecular Cancer Therapeutics 9(11):3052-3064 (2010).

Tkalec et al., "Isolation and expression in *Escherichia coli* of cs1A and cs1B, genes coding for the chondroitin sulfate-degrading enzymes chondroitinase AC and chondroitinase B, respectively, from Flavobacterium heparinum," Applied and Environmental Microbiology 66(1):29-35 (2000).

Tsubery et al., "Prolonging the action of protein and peptide drugs by a novel approach of reversible polyethylene glycol modification," J Biol. Chem 279(37):38118-38124 (2004).

Tsuda et al., "Substrate specificity studies of flavobacterium chondroitinase C and heparitinases towards the glycosaminoglycan—protein linkage region. Use of a sensitive analytical method developed by chromophore-labeling of linkage glycoserines using dimethylaminoazobenzenesulfonyl chloride," Eur. J. Biochem. 262:127-133 (1999).

Udenfriend, S. and K. Kodukula, "Prediction of omega site in nascent precursor of glycosylphosphatidylinositol protein," Methods Enzymol. 250:571-582 (1995).

USP XXII-NF XVII, United States Pharmacopeia Convention, Inc, Rockville, MD., pp. 644-645 (1990).

Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:197-207 (1997).

Wagner et al., "Nucleotide sequence of the thymidine kinase gene of herpes simplex virus type I," Proc. Natl. Acad. Sci. USA 78:1441-1445 (1981).

Watson et al., *Molecular Biology of the Gene*, 4th Edition, The Benjamin/Cummings Pub. Co., p. 224 (1987).

Wilson, J., "The testes and the prostate: a continuing relationship," N. Engl. J. Med. 317(10):628-629 (1987).

Yamagata et al., "Purification and properties of bacterial chondroitinases and chondrosulfatases," J. Biol. Chem. 243:1523-1535 (1968).

Yamamoto et al., "Identification of a functional promoter in the long terminal repeat of Rous sarcoma virus," Cell 22:787-797 (1980).

Yang et al., "Purification and characterization of heparinase from Flavobacterium heparinum," J. Biol. Chem. 160(30):1849-1857 (1985).

Ye et al., "DepoFoam technology: a vehicle for controlled delivery of protein and peptide drugs," J Controlled Release 64:155-166 (2000).

Zalipsky, S., "Chemistry of polyethylene glycol conjugates with biologically active molecules," Adv. Drug Del. Rev. 16:157-182 (1995).

Zhang et al., "Ablation of canine prostate using two-stage intraprostatic hot agarose solution and enzyme injection," Prostate Cancer and Prostatic Diseases 7:316-320 (2004).

Zhao, X. and J. Harris, "Novel degradable poly(ethylene glycol) esters for delivery," in Poly(ethylene glycol), Chemistry and Biological Applications, ACS Symposium Series 680, Hams, J. and S. Zalipsky, (eds), pp. 458-472 (1997).

Frost, G., "Halozyme Therapeutics, Inc. Thinking outside the cell," presented at J. P. Morgan Healthcare Conference on Jan. 10, 2013. Presentation. 23 pages.

Halozyme Therapeutics, Analyst and Investor Meeting presentations including by Lim, J., "Introduction and strategic review," Little, R., "Leveraging the technology across multiple partners," Frost, G., "Discovery and early development pipeline update," and D. Muchmore, "Ultrafast insulin-PH20 program-where we are going," Presented Oct. 15, 2009 in New York. Oral Presentation, 88 pages.

(56) References Cited

OTHER PUBLICATIONS

Li et al., "Pegylated human recombinant hyaluronidase PH20 (PEGPH20) combined with finasteride inhibits rat prostatic hyperplasia in the rat testosterone enanthate BPH model," Western Section American Urological Association—WSAUA meeting, Waikoloa, HI Oct. 23-29, 2010. Abstract submitted Jun. 14, 2010, 1 page.

Li et al., "Pegylated human recombinant hyaluronidase PH20 (PEGPH20) combined with finasteride inhibits rat prostatic hyperplasia in the rat testosterone enanthate BPH model," Western Section American Urological Association—WSAUA meeting, Waikoloa, HI Oct. 23-29, 2010 Poster Presented Oct. 24, 2010, 1 page.

Shepard et al.,"Hyaluronan: the glue that holds a tumor together," Biotherapeutic Targets, Boston, MA, May 21, 2010. Oral presentation, 26 pages.

Halozyme Therapeutics, "Securities and Exchange Commission Form 10Q," Aug. 6, 2010, 42 pages.

News Release, Halozyme Therapeutics, Inc., "First Quarter 2011 Financial Results Conference Call Transcript," Published on May 6, 2011[online][retrieved on Jul. 25, 2011] Retrieved from:<URL: phx.corporate.ir.net/External.File?item=UGFyZW50SUQ9NDI5MDMwfENoaWxkSUQ9NDQ2MjI4fFR5cGU9MQ==&t=1, 12 pages.

News Release, Halozyme Therapeutics, Inc., "Halozyme therapeutics presents pre-clinical studies with systemic delivery of pegylated rHuPH20 enzyme in prostate cancer models at American Association for Cancer Research," Published on Apr. 15, 2008[online][retrieved on Jul. 16, 2009] Retrieved from:<URL:halozyme.com/Investors/News-Releases/News-Release-Details/2008/Halozyme-Therapeutics-Presents-Pre-Clinical-Studies-of-Systemic-Delivery-of-Pegylated-rHuPH20-Enyzme-in-Prostate-Cancer-Model/default.aspx, 3 pages.

News Release, "Halozyme Therapeutics to Present at the 31st Annual J.P. Morgan Healthcare Conference," Published Jan. 3, 2013 [online][Retrieved Jan. 17, 2013][Retrieved from the Internet: URL.//www.halozyme.com/Investors/News-Releases/News-Release-Details/2013/Halozyme-Therapeutics-to-Present-at-the-31st-Annual-JP-Morgan-Healthcare-Conference1132508/default.aspx, 2 pages.

Partial International Search Report, mailed Apr. 4, 2012, in connection with International Patent Application No. PCT/US2012/024376, 2 pages.

International Search Report and Written Opinion, mailed Jun. 12, 2012 in connection with International Patent Application No. PCT/US2012/024376, 18 pages.

Response to Written Opinion, mailed Jun. 12, 2012 in connection with International Patent Application No. PCT/US2012/024376, 42 pages.

International Preliminary Report on Patentability, mailed Mar. 19, 2013, in connection with International Patent Application No. PCT/US2012/024376, 11 pages.

Letter/Written Disclosure of the Information Disclosure Statement for the above-referenced application, filed herewith on Jan. 7, 2016, 3 pages.

"Benign Prostatic Hyperplasia," Merck Manuals (Japanese Version): 18th Edition; Nikkei Business Publications, Inc. (2007) pp. 2169-2171 [In Japanese].

"Benign Prostatic Hyperplasia," Merck Manuals (English Version)[online] [retrieved on Dec. 10, 2015] retrieved from <URL:http://www.merckmanuals.com/professional/genitourinary-disorders/benign-prostate-disease/benign-prostatic-hyperplasia--(bph), 7 pages.

Office Action, issued Nov. 24, 2015 in connection with Japanese Patent Application No. 2013-552741 [English translation and original document in Japanese], 15 pages.

Letter/Written Disclosure of the Supplemental Information Disclosure Statement for the above-referenced application, filed herewith Nov. 16, 2015, 2 pages.

"PEGPH20: The Science & The Strategy," presented at J. P. Morgan Healthcare Conference on Jan. 7, 2015. Presentation, 81 pages.

Frost, G.I., "Halozyme Therapeutics, Inc. Thinking outside the cell," Oct. 2013. Presentation, 46 pages.

Communication under Rule 71(3) EPC (Intention to Grant), issued Jul. 14, 2014, in connection with European Patent Application No. 12704217.4, 5 pages.

Extended European Search Report, issued May 28, 2015, in connection with European Patent Application No. 15158288.9, 4 pages.

Response, filed Oct. 6, 2015, to Extended European Search Report, issued May 28, 2015, in connection with European Patent Application No. 15158288.9, 8 pages.

COMPOSITION AND LIPID FORMULATION OF A HYALURONAN-DEGRADING ENZYME AND THE USE THEREOF FOR TREATMENT OF BENIGN PROSTATIC HYPERPLASIA

RELATED APPLICATIONS

This application is a continuation of International Application No. PCT/US2012/024376, filed on Feb. 8, 2012, entitled "COMPOSITION AND LIPID FORMULATION OF A HYALURONAN-DEGRADING ENZYME AND THE USE THEREOF FOR TREATMENT OF BENIGN PROSTATIC HYPERPLASIA," which claims priority to U.S. Provisional Application Ser. No. 61/462,875, entitled "COMPOSITION AND LIPID FORMULATION OF A HYALURONAN-DEGRADING ENZYME AND THE USE THEREOF FOR TREATMENT OF BENIGN PROSTATIC HYPERPLASIA," filed Feb. 8, 2011. The subject matter of the above-referenced applications is incorporated by reference in its entirety.

INCORPORATION BY REFERENCE OF SEQUENCE LISTING PROVIDED ELECTRONICALLY

An electronic version on compact disc (CD-R) of the Sequence Listing is filed herewith in duplicate (labeled Copy 1 and Copy 2), the contents of which are incorporated by reference in their entirety. The computer-readable file on each of the aforementioned compact discs, created Feb. 15, 2013, is identical, 800 kilobytes in size, and titled 3082seq.001.txt. A substitute Sequence Listing, incorporated by reference in its entirety, is provided on identical compact discs (labeled Copy 1 Replacement May 28, 2013, Copy 2 Replacement May 28, 2013). The computer-readable file on each of the aforementioned compact discs, created on May 28, 2103, is identical, 800 kilobytes in size, and titled 3082seq.002.txt.

FIELD OF THE INVENTION

Provided are compositions and formulations or co-formulations containing a hyaluronan degrading enzyme. The compositions, formulations or co-formulations can also contain another therapeutic agent, such as one that is suitable for treatment of Benign Prostatic Hyperplasia, for example, a 5-alpha reductase inhibitor. The compositions and formulations can be used for the treatment of Benign Prostatic Hyperplasia. The compositions and formulations can be provided in combinations with one or more other agents for the treatment of Benign Prostatic Hyperplasia.

SUMMARY

Provided herein are multivesicular liposomes (MVLs) containing a neutral lipid, an amphipathic lipid and a hyaluronan-degrading enzyme. The hyaluronan-degrading enzyme in the MVLs generally has an activity of at least 40,000 U/mg. The concentration of the hyaluronan-degrading enzyme is between or about between 0.1 mg/mL to 1 mg/mL, 0.2 mg/mL to 0.5 mg/mL, or is at least or about or 0.1 mg/mL, 0.2 mg/mL, 0.3 mg/mL, 0.4 mg/mL, 0.5 mg/mL, 0.6 mg/mL, 0.7 mg/mL, 0.8 mg/mL or 0.9 mg/mL.

In some examples, the MVLs contain hyaluronic acid (HA). The HA can be present in an amount sufficient to increase the encapsulation and enzymatic activity of the hyaluronan-degrading enzyme. The concentration of hyaluronic acid in the MVLs is between or about between 0.05 mg/mL to 50 mg/mL, 0.75 mg/mL to 13.0 mg/mL, or 1 mg/mL to 10 mg/mL or is at least or about or 0.1 mg/mL, 0.5 mg/mL or 1 mg/mL. In some examples, the ratio of hyaluronic acid to hyaluronan-degrading enzyme is 1:500, 1:400, 1:300, 1:200, 1:100, 1:90, 1:80, 1:70, 1:60, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, 20:1, 30:1, 40:1, 50:1, 60:1, 70:1, 80:1, 90:1, 100:1, 200:1, 300:1, 400:1, 500:1.

In examples herein, the MVLs can be made by a process or obtainable by a process that includes a) forming a first aqueous component containing a hyaluronan degrading enzyme in a concentration less than 2 mg/mL; b) forming a lipid component containing at least one organic solvent, at least one amphipathic lipid and at least one neutral lipid; c) forming an emulsion from the first aqueous component and the lipid component; d) dispersing the emulsion into a second aqueous component to form solvent spherules; and e) removing the organic solvent from the solvent spherules to form multivesicular liposomes suspended in the second aqueous component. In the process, the hyaluronan-degrading enzyme in the first aqueous component is in a concentration of between or about between 0.1 mg/mL to 1.9 mg/mL, 0.5 mg/mL to 1.5 mg/mL or is or is about 1 mg/mL. The first aqueous component also can contain an excipient that is sucrose, calcium chloride ($CaCl_2$), glycerol, dextran, PEG (e.g. PEG-6000), hyaluronic acid (HA), proline, Arg-HCl, Sorbitol, trehalose, human serum albumin (HSA), or a combination thereof. In such examples, $CaCl_2$ between or about between 1 mM to 50 mM $CaCl_2$, 5 mM to 25 mM $CaCl_2$, 10 mM to 20 mM $CaCl_2$, or at least or about or 10 mM, 15 mM or 20 mM; dextran is between or about between 0.01% to 1% or 0.05% to 0.5% or at least or about or 0.1%; PEG is between or about between 0.01% to 1% or 0.05% to 0.5% or at least or about or 0.1%; proline is between or about between 1 mM to 1 M, 10 mM to 500 mM proline or at least or about or 100 mM; arginine is between or about between 1 mM to 1 M, 10 mM to 500 mM or at least or about or 100 mM; sorbitol is between or about between 1% to 20%, 5% to 15% sorbitol or at least or about or 5%, 6%, 7%, 8%, 9%, 10%; and/or trehalose between or about between 1% to 20%, 5% to 15% trehalose or at least or about or 5%, 6%, 7%, 8%, 9%, 10%; and/or hyaluronic acid (HA) between or about between 1 mg/mL to 100 mg/mL, 10 mg/mL to 75 mg/mL, or mg/mL to 50 mg/mL, or at least or about or 1 mg/mL HA, 2 mg/mL HA, 3 mg/mL HA, 4 mg/mL HA, 5 mg/mL HA, 6 mg/mL HA, 7 mg/mL HA, 8 mg/mL HA, 9 mg/mL HA, 10 mg/mL HA, 11 mg/mL HA, 12 mg/mL HA, 13 mg/mL HA, 14 mg/mL HA, 15 mg/mL HA, 16 mg/mL HA, 17 mg/mL HA, 18 mg/mL HA, 19 mg/mL HA, 20 mg/mL HA, 25 mg/mL HA, 30 mg/mL HA, 40 mg/mL HA, 50 mg/mL HA.

In the MVLs provided herein, the MVLs can be made by a process that also includes removing the second aqueous component and suspending the multivesicular liposomes in a third aqueous component. The third aqueous component can contain NaCl, for example, between or about between 100 mM to 150 mM or is at least or about or 100 mM, 110 mM, 120 mM, 130 mM, 140 mM or 150 mM; and/or histidine, for example between 1 mM to 100 mM, 5 mM to 15 mM or is at least or about 1 mM, 5 mM, 10 mM, 15 mM, 20 mM, 25 mM, 30 mM, 40 mM or 50 mM. The pH of the third aqueous buffer is or is about between 6.0 to 8.0 or 6.5 to 7.5 or is at least or about or 6.0, 6.5, 7.0 or 7.4.

In the MVLs provided herein, the MVLs can contain or can be made or obtainable by a process containing a neutral lipid that is a diglyceride or a triglyceride. For example, the neutral lipid is a triglyceride that is triolein or tricaprylin, or a mixture of triolein and tricaprylin. In some examples, the triolein and tricaprylin are in a 50:50 (1:1) molar ratio. In examples of the MVLs provided herein, the MVLs can contain or can be made or obtainable by a process containing an amphipathic lipid that is a phosphatidylglycerol (PG), cardiolipin (CL), phosphatidylserine (PS), phosphatidic acid (PA), phosphatidylinositol, phosphatidylcholine (PC), phosphatidylethanolamine (PE), sphingomyelin, or diacyl trimethylammonium propane (DITAP). For example, the amphipathic lipid is a phosphatidylcholine that is DEPC or DOPC, or a mixture of DEPC and DOPC. The DEPC and DOPC are in a molar ratio that is at least or about at least 50:50 (1 DEPC:1 DOPC), 75:25 (3 DEPC:1 DOPC), or 90:10 (9 DEPC:1 DOPC). In examples of the MVLs provided herein, the MVLs can further contain or be manufactured by a process containing DPPG, cholesterol or DPPG and cholesterol.

In any of the MVLs provided herein, the MVLs contain, such as from manufacture by a process containing, a further therapeutic agent. The therapeutic agent can be hydrophilic or hydrophobic. Typically, the therapeutic agent is an agent to treat benign prostatic hyperplasia. For example, the therapeutic agent is an anti-androgen, alpha blocker, *boutlinum* toxin or a hydrolytic enzyme. The anti-androgen can be a steroid anti-androgen, a non-steroid anti-androgen or a 5α-reductase inhibitor. In particular examples, the agent is finasteride or dutasteride.

Also provided herein are compositions or combinations containing any of the MVLs provided herein. The compositions or combinations can further contain a therapeutic agent. The therapeutic agent can be formulated separately from the multivesicular liposome. Exemplary of a therapeutic agent is an agent suitable for treating benign prostatic hyperplasia. For example, the therapeutic agent is an anti-androgen, alpha blocker, *boutlinum* toxin, and a hydrolytic enzyme. The anti-androgen is a steroid anti-androgen, a non-steroid anti-androgen or a 5α-reductase inhibitor. The 5α-reductase inhibitors are finasteride or dutasteride. Also provided herein are containers or kits containing any of the compositions or combinations.

Also provided herein are compositions containing a hyaluronan-degrading enzyme; and hyaluronic acid, whereby the hyaluronan-degrading enzyme retains at least 50% of the hyaluronidase activity for at least six months at 28° C. to 32° C. or at least one year at 2° C. to 8° C. For example, at least 60%, 70%, 80%, 85%, 90%, 95% or more hyaluronidase activity is retained. The hyaluronan-degrading enzyme and hyaluronic acid in the composition are at a molar ratio of or about 5000:1, 4000:1, 3000:1, 2000:1, 1900:1, 1800:1, 1700:1, 1650:1, 1600:1, 1500:1, 1400:1, 1300:1, 1200:1, 1100:1, 1000:1, 900:1, 800:1, 700:1, 600:1, 500:1, 100:1, 90:1, 80:1, 70:1, 60:1, 50:1, 40:1, 30:1, 20:1, 10:1, 1:1, 1:10, 1:20, 1:30, 1:40, 1:50, 1:60, 1:70, 1:80, 1:90, 1:100, 1:500, 1:600, 1:700, 1:800, 1:900, 1:1000, 1:1100, 1:1200, 1:1300, 1:1400, 1:1500, 1:1600, 1:1700, 1:1800, 1:1900, 1:2000, 1:3000, 1:4000, 1:5000. The concentration of hyaluronan-degrading enzyme in the composition is or is about between or at least 1 U/mL to 10000 U/mL, 10 U/mL to 5000 U/mL, 100 U/mL to 1000 U/mL or is at least or about or 10 U/mL, 50 U/mL, 100 U/mL, 200 U/mL, 300 U/mL, 400 U/mL, 500 U/mL, 600 U/mL, 700 U/mL, 800 U/mL, 900 U/mL, 1000 U/mL or more. The concentration of hyaluronic acid is or is about between 1 mg/mL to 100 mg/mL, 10 mg/mL to 50 mg/mL, 1 mg/mL to 20 mg/mL or is at least or about or 1 mg/mL, 2 mg/mL, 3 mg/mL, 4 mg/mL, 5 mg/mL, 6 mg/mL, 7 mg/mL, 8 mg/mL, 9 mg/mL, 10 mg/mL, 11 mg/mL, 12 mg/mL, 13 mg/mL, 14 mg/mL, 15 mg/mL, 16 mg/mL, 17 mg/mL, 18 mg/mL, 19 mg/mL, 20 mg/mL, 30 mg/mL, 40 mg/mL, or 50 mg/mL. The composition can be formulated for single or multiple use. The composition can be formulated in a volume per administration of between or about 0.5 mL to 50 mL, 1 mL to 10 mL, 1 mL to 5 mL or at least or about or 1 mL, 2 mL, 3 mL, 4 mL, 5 mL, 6 mL, 7 mL, 8 mL, 9 mL, 10 mL, 20 mL, 30 mL, 40 mL or 50 mL.

In any of the examples of the MVLs provided herein or compositions provided herein, the hyaluronan-degrading enzyme is a hyaluronidase, a chondroitinase or a lyase. For example, the hyaluronidase is a mammalian-type hyaluronidase or a bacterial hyaluronidase. In some examples, the hyaluronidase is a PH20 hyaluronidase. The PH20 hyaluronidase can be an ovine, mouse, monkey, bovine, bacterial and human PH20. The PH20 is generally soluble or is a form that is secreted when expressed in a mammalian cell, such as a CHO cell. The soluble PH20 can be one that lacks a C-terminal glycosylphosphatidylinositol (GPI) attachment site or a portion of the GPI attachment site. For example, the soluble PH20 has a sequence of amino acids that is a truncated form of the polypeptide set forth in SEQ ID NO:2, whereby the soluble PH20 lacks all or a portion of the C-terminal GPI attachment site, or has a sequence of amino acids that exhibits at least 91%, 92%, 93%, 94%, 95%, 96%, 97%, 98%, 99% or greater sequence identity to the truncated form thereof. In particular examples, the soluble PH20 has a sequence of amino acids set forth in any of SEQ ID NOS: 4-9 and 46-48, and allelic variants, species variants and other variants thereof. In examples herein, the hyaluronan-degrading enzyme is glycosylated. The hyaluronan-degrading enzyme also can be modified by conjugation to a polymer. The polymer is PEG or dextran. The hyaluronan-degrading enzyme also can be linked, directly or indirectly, to a label or detectable moiety. For example, the label or detectable moiety is a fluorescent protein.

Provided herein are methods of treatment of a hyaluronan-degrading enzyme, such as benign prostatic hyperplasia by administering any of the compositions or combinations provided herein. Also provided are uses of any of the compositions or combinations provided herein for treating benign prostatic hyperplasia.

BACKGROUND

Benign Prostatic Hypertrophy or Hyperplasia (BPH) is a non cancerous condition resulting from the enlargement of the prostate gland as a consequence of the natural progression of prostate growth with age. The prostate capsule around the prostate gland may prevent the prostate gland from enlarging further. This causes the inner region of the prostate gland to squeeze the urethra. Compression of the urethra increases resistance to urine flow through the region of the urethra surrounded by the prostate. The urinary bladder has to exert more pressure to force urine through the restricted urethra which results in hypertrophy of the walls of the urinary bladder, stiffness and the exhibiting of a variety of lower urinary tract symptoms (LUTS). LUTS include weak or intermittent urine flow while urinating, straining when urinating, hesitation before urine starts flowing, feeling that the bladder has not emptied completely even after urinating, dribbling at the end of urination or leakage afterward, increased frequency of urination particularly at night and the urgent need to urinate. BPH is one of the most common medical conditions that affect men, especially elderly men. It has been reported that BPH effects 50% of men by age 50 and 75% of men by age 80. Due to the aging of the population, the prevalence of BPH is expected to substantially increase over the next 20 years. Severe BPH can cause serious problems such as a diminished quality of life, urinary tract infection, bladder and kidney damage, incontinence and most seriously, gross hematuria and renal failure due to obstructive uropathy. Of the current strategies available to treat BPH, including use of drugs and surgery, all have adverse consequences. Hence, there is a need for alternative treatment regimes.

DETAILED DESCRIPTION

Outline
A. DEFINITIONS
B. OVERVIEW—Accumulated Hyaluronan (HA) in Disease and Hydrolysis Thereof
C. HYALURONAN DEGRADING ENZYMES
  1. Hyaluronidases
    a. Mammalian-type hyaluronidases
      i. PH20
      ii. Human PH20
    b. Bacterial hyaluronidases
    c. Hyaluronidases from leeches, other parasites and crustaceans
  2. Other hyaluronan degrading enzymes
  3. Soluble hyaluronan degrading enzymes
    a. Soluble Human PH20
  4. Variant Hyaluronan-Degrading Enzymes
  5. Glycosylation of hyaluronan degrading enzymes
  6. Modified Hyaluronan Degrading Enzymes
  7. Methods of Producing Nucleic Acids and Encoded Polypeptides of Hyaluronan Degrading Enzymes
    a. Vectors and cells
    b. Expression
      i. Eukaryotic Cells
      ii. Yeast Cells
      iii. Insect Cells
      iv. Mammalian Cells
      v. Plants
    c. Purification techniques
D. COMPOSITIONS AND SUSTAINED RELEASE FORMULATIONS OF HYALURONAN-DEGRADING ENZYMES
  1. Hyaluronan Degrading Enzyme Compositions
  2. Sustained Release Formulations
    a. Depot Gel formulation
    b. Multivesicular Liposomes (MVL)
      i. Parameters to Improve Encapsulation, Stability and Release Rate
      ii. Exemplary MVL-Hyaluronan-Degrading Enzyme Formulations
      iii. MVL Co-Formulations
      iv. Assessing Encapsulation And Efficiency
E. DOSAGE, ADMINISTRATION & METHODS OF TREATMENT
F. COMBINATION THERAPY FOR THE TREATMENT OF BENIGN PROSTATIC HYPERTROPHY
  1. Anti-androgens
    a. Steriodal anti-androgens
    b. Non-steriodal anti-androgens
    c. 5α-reductase inhibitors
  2. Alpha blocking agents
  3. *Botulinum* toxin and modified BTs
  4. Other Agents
  5. Articles of Manufacture
  6. Kits
G. METHODS OF ASSESSING EFFICACY
  1. Animal Models
  2. In Vitro Procedures
H. Examples A. Definitions Unless defined otherwise, all technical and scientific terms used herein have the same meaning as is commonly understood by one of skill in the art to which the invention(s) belongs/belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it is understood that such identifiers can change and particular information on the internet can come and go, but equivalent information can be found by searching the internet. Reference thereto evidences the availability and public dissemination of such information.

As used herein, about the same means within an amount that one of skill in the art would consider to be the same. Typically, for pharmaceutical compositions, within at least 1%, 2%, 3%, 4%, 5% 10% is considered about the same. Such amount can vary depending upon the tolerance for variation in the particular composition by subjects.

As used herein, when referencing dosage based on mg/kg of the subject, an average human subject is considered to have a mass of about 70 kg.

As used herein, "intravenous administration" refers to delivery of a therapeutic directly into a vein.

As used herein, "hyaluronidase" refers to a class of enzymes that degrades hyaluronan. Hyaluronidases include, but are not limited to, bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary human hyaluronidases include HYAL1, HYAL2, HYAL3, HYAL4, and PH20 (SEQ ID NO:1). Also included amongst hyaluronidases are soluble hyaluronidases, including, ovine and bovine PH20, soluble human PH20 and rHuPH20. Examples of commercially available bovine or ovine soluble hyaluronidases are Vitrase® hyaluronidase (ovine hyaluronidase) and Amphadase® hyaluronidase (bovine hyaluronidase).

As used herein, "PH20" refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, *Cynomolgus* monkey, *Rhesus* monkey, murine, bovine, ovine, guinea pig, rabbit and rat origin. Exemplary PH20 polypeptides include those from human (SEQ ID NO:1), chimpanzee (SEQ ID NO:101), *Rhesus* monkey (SEQ ID NO:102), *Cynomolgus* monkey (SEQ ID NO:29), cow (e.g., SEQ ID NOS:11 and 64); mouse (SEQ ID NO:32); rat (SEQ ID NOS:31); rabbit (SEQ ID NO:25); sheep (SEQ ID NOS:27, 63 and 65) and guinea pig (SEQ ID NO:30). Reference to PH20 includes precursor PH20 polypeptides and mature PH20 polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NO:93 and 95, or the mature forms thereof. PH20 polypeptides also include those that contain chemical or posttranslational modifications and those that do not contain chemical or posttranslational modifications. Such modifications include, but are not limited to, pegylation, albumination, glycosylation, farnesylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, a "soluble PH20" refers to any form of PH20 that is soluble under physiologic conditions. A soluble PH20 can be identified, for example, by its partitioning into the aqueous phase of a Triton® X-114 solution at 37° C. (Bordier et al., (1981) J. Biol. Chem., 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also include recombinant soluble PH20 and those contained in or purified from natural sources, such as, for example, testes extracts from sheep or cows. Exemplary of such soluble PH20 is soluble human PH20.

As used herein, soluble human PH20 or sHuPH20 includes PH20 polypeptides lacking all or a portion of the glycosylphosphatidylinositol (GPI) anchor sequence at the C-terminus such that upon expression, the polypeptides are soluble under physiological conditions. Solubility can be assessed by any suitable method that demonstrates solubility under physiologic conditions. Exemplary of such methods is the Triton® X-114 assay, that assesses partitioning into the aqueous phase and that is described above and in the examples. In addition, a soluble human PH20 polypeptide is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion in CHO cells is definitional. Hence, if a polypeptide could be expressed and secreted in CHO cells and is soluble, i.e. partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e. native) signal sequence. Exemplary of the precursors are those that include a signal sequence, such as the native 35 amino acid signal sequence at amino acid positions 1-35 (see, e.g., amino acids 1-35 of SEQ ID NO:1).

As used herein, an "extended soluble PH20" or "esPH20" includes soluble PH20 polypeptides that contain residues up to the GPI anchor-attachment signal sequence and one or more contiguous residues from the GPI-anchor attachment signal sequence such that the esPH20 is soluble under physiological conditions. Solubility under physiological conditions can be determined by any method known to those of skill in the art. For example, it can be assessed by the Triton® X-114 assay described above and in the examples. In addition, as discussed above, a soluble PH20 is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion in CHO cells is definitional. Hence, if a polypeptide could be expressed and secreted in CHO cells and is soluble, i.e. partitions into the aqueous phase when extracted with Triton® X-114, it is a soluble PH20 polypeptide whether or not it is so-produced. Human soluble esPH20 polypeptides include, in addition to residues 36-490, one or more contiguous amino acids from amino acid residue position 491 of SEQ ID NO:1 inclusive, such that the resulting polypeptide is soluble. Exemplary human esPH20 soluble polypeptides are those that have amino acids residues corresponding to amino acids 36-491, 36-492, 36-493, 36-494, 36-495, 36-496 and 36-497 of SEQ ID NO.1. Exemplary of these are those with an amino acid sequence set forth in any of SEQ ID NOS: 151-154 and 185-187. Also included are allelic variants and other variants, such as any with 40%, 45%, 50%, 55%, 65%, 70%, 75%, 80%, 85%, 90%, 91%, 92%, 93%, 94%, 95%, 96%, 97%, 98%, 99% or greater sequence identity with the corresponding polypeptides of SEQ ID NOS: 151-154 and 185-187 that retain neutral activity and are soluble. Reference to sequence identity refers to variants with amino acid substitutions.

As used herein, reference to "esPH20s" includes precursor esPH20 polypeptides and mature esPH20 polypeptides (such as those in which a signal sequence has been removed), truncated forms thereof that have enzymatic activity (retaining at least 1%, 10%, 20%, 30%, 40%, 50% or more of the full-length form) and are soluble, and includes allelic variants and species variants, variants encoded by splice variants, and other variants, including polypeptides that have at least 40%, 45%, 50%, 55%, 65%, 70%, 75%, 80%, 85%, 90%, 91%, 92%, 93%, 94%, 95%, 96%, 97%, 98%, 99% or more sequence identity to the precursor polypeptides set forth in SEQ ID NOS:1 and 3, or the mature forms thereof.

As used herein, reference to "esPH20s" also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art.

As used herein, "soluble recombinant human PH20 (rHuPH20)" refers to a soluble form of human PH20 that as recombinantly expressed and secreted in Chinese Hamster Ovary (CHO) cells. Soluble rHuPH20 is encoded by nucleic acid that includes the signal sequence and is set forth in SEQ ID NO:49. Also included are DNA molecules that are allelic variants thereof and other soluble variants. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NO:4 to SEQ ID NO:9 in various abundance.

Similarly, for other forms of PH20, such as the esPH20s, recombinantly expressed polypeptides and compositions thereof can include a plurality of species whose C-terminus exhibits heterogeneity. For example, compositions of recombinantly expressed esPH20 produced by expression of the polypeptide of SEQ ID NO:151, which encodes an esPH20 that has amino acids 36-497, can include forms with fewer amino acids, such as 36-496, 36-495.

As used herein, an "N-linked moiety" refers to an asparagine (N) amino acid residue of a polypeptide that is capable of being glycosylated by post-translational modification of a polypeptide. Exemplary N-linked moieties of human PH20 include amino acids N82, N166, N235, N254, N368 and N393 of human PH20 set forth in SEQ ID NO:1.

As used herein, an "N-glycosylated polypeptide" refers to a PH20 polypeptide or truncated form thereto containing oligosaccharide linkage of at least three N-linked amino acid residues, for example, N-linked moieties corresponding to amino acid residues N235, N368 and N393 of SEQ ID NO:1. An N-glycosylated polypeptide can include a polypeptide where three, four, five and up to all of the N-linked moieties are linked to an oligosaccharide. The N-linked oligosaccharides can include oligomannose, complex, hybrid or sulfated oligosaccharides, or other oligosaccharides and monosaccharides.

As used herein, an "N-partially glycosylated polypeptide" refers to a polypeptide that minimally contains an N-acetylglucosamine glycan linked to at least three N-linked moieties. A partially glycosylated polypeptide can include various glycan forms, including monosaccharides, oligosaccharides, and branched sugar forms, including those formed by treatment of a polypeptide with EndoH, EndoF1, EndoF2 and/or EndoF3.

As used herein, a "deglycosylated PH20 polypeptide" refers to a PH20 polypeptide in which fewer than all possible glycosylation sites are glycosylated. Deglycosylation can be effected, for example, by removing glycosylation, by preventing it, or by modifying the polypeptide to eliminate a glycosylation site. Particular N-glycosylation sites are not required for activity, whereas others are.

As used herein, "pegylated" refers to covalent or other stable attachment of polymeric molecules, such as polyethylene glycol (pegylation moiety PEG) to hyaluronan degrading enzymes, such as hyaluronidases, typically to increase half-life of the hyaluronan degrading enzyme.

As used herein, a "conjugate" refers to a polypeptide linked directly or indirectly to one or more other polypeptides or chemical moieties. Such conjugates include fusion proteins, those produced by chemical conjugates and those produced by any other methods. For example, a conjugate refers to soluble PH20 polypeptides linked directly or indirectly to one or more other polypeptides or chemical moieties, whereby at least one soluble PH20 polypeptide is linked, directly or indirectly to another polypeptide or chemical moiety so long as the conjugate retains hyaluronidase activity. Exemplary of conjugates provided herein include PH20 polypeptides linked directly or indirectly to a multimerization domain, such as an Fc moiety, a toxin, a label or a drug.

As used herein, a "fusion" protein refers to a polypeptide encoded by a nucleic acid sequence containing a coding sequence from one nucleic acid molecule and the coding sequence from another nucleic acid molecule in which the coding sequences are in the same reading frame such that when the fusion construct is transcribed and translated in a host cell, the protein is produced containing the two proteins. The two molecules can be adjacent in the construct or separated by a linker polypeptide that contains, 1, 2, 3, or more, but typically fewer than 10, 9, 8, 7, or 6 amino acids. The protein product encoded by a fusion construct is referred to as a fusion polypeptide. Exemplary of fusion polypeptides include Fc fusions.

As used herein, a "polymer" refers to any high molecular weight natural or synthetic moiety that is conjugated to, i.e. stably linked directly or indirectly via a linker, to a polypeptide. Such polymers, typically increase serum half-life, and include, but are not limited to sialic moieties, pegylation moieties, dextran, and sugar and other moieties, such as for glycosylation. For example, hyaluronidases, such as a soluble PH20 or rHuPH20, can be conjugated to a polymer.

As used herein, "activity" refers to a functional activity or activities of a polypeptide or portion thereof associated with a full-length (complete) protein. For example, active fragments of a polypeptide can exhibit an activity of a full-length protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, "hyaluronidase activity" refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as PH20, including soluble PH20 and esPH20, are known in the art and described herein. Exemplary assays include the microturbidity assay that measures cleavage of hyaluronic acid by hyaluronidase indirectly by detecting the insoluble precipitate formed when the uncleaved hyaluronic acid binds with serum albumin. Reference Standards can be used, for example, to generate a standard curve to determine the activity in Units of the hyaluronidase being tested.

As used herein, "neutral active" refers to the ability of a PH20 polypeptide to enzymatically catalyze the cleavage of hyaluronic acid at neutral pH (e.g. at or about pH 7.0). Generally, a neutral active and soluble PH20, e.g., C-terminally truncated or N-partially glycosylated PH20, has or has about 30%, 40%, 50%, 60%, 70%, 80%, 90%, 91%, 92%, 93%, 94%, 95%, 96%, 97%, 98%, 99%, 100%, 110%, 120%, 130%, 140%, 150%, 200%, 300%, 400%, 500%, 1000% or more activity compared to the hyaluronidase activity of a corresponding neutral active PH20 that is not C-terminally truncated or N-partially glycosylated.

As used herein, a "GPI-anchor attachment signal sequence" is a C-terminal sequence of amino acids that directs addition of a preformed GPI-anchor to the polypeptide within the lumen of the ER. GPI-anchor attachment signal sequences are present in the precursor polypeptides of GPI-anchored polypeptides, such as GPI-anchored PH20 polypeptides. The C-terminal GPI-anchor attachment signal sequence typically contains a predominantly hydrophobic region of 8-20 amino acids, preceded by a hydrophilic spacer region of 8-12 amino acids, immediately downstream of the w-site, or site of GPI-anchor attachment. GPI-anchor attachment signal sequences can be identified using methods well known in the art. These include, but are not limited to, in silico methods and algorithms (see, e.g. Udenfriend et al. (1995) *Methods Enzymol.* 250:571-582, Eisenhaber et al., (1999) *J. Biol. Chem.* 292: 741-758, Fankhauser et al., (2005) *Bioinformatics* 21:1846-1852, Omaetxebarria et al., (2007) *Proteomics* 7:1951-1960, Pierleoni et al., (2008) BMC Bioinformatics 9:392), including those that are readily available on bioinformatic websites, such as the ExPASy Proteomics tools site (e.g., the WorldWideWeb site expasy.ch/tools/).

As used herein, "nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to 2 amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, the "naturally occurring α-amino acids" are the residues of those 20 α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-stereoisomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g. Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carrillo, H. & Lipton, D., SIAM J Applied Math 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; Carrillo et al. (1988) SIAM J Applied Math 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I): 387 (1984)), BLASTP, BLASTN, FASTA (Altschul, S. F., et al., *J Mol Biol* 215:403 (1990)); Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman ((1981) Adv. Appl. Math. 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human. For example for PH20, exemplary of species variants provided herein are primate PH20, such as, but not limited to, human, chimpanzee, macaque and cynomolgus monkey. Generally, species variants have 70%, 75%, 80%, 85%, 90%, 91%, 92%, 93%, 94%, 95%, 96%, 97%, 98% or sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to greater than 99%. The position of interest is then given the number assigned in the reference nucleic acid molecule. Alignment can be effected manually or by eye, particularly, where sequence identity is greater than 80%.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements (e.g. substitutions) of amino acids and nucleotides, respectively. Exemplary of modifications are amino acid substitutions. An amino-acid substituted polypeptide can exhibit 65%, 70%, 80%, 85%, 90%, 91%, 92%, 93%, 94%, 95%, 96%, 97%. 98% or more sequence identity to a polypeptide not containing the amino acid substitutions. Amino acid substitutions can be conservative or non-conservative. Generally, any modification to a polypeptide retains an activity of the polypeptide. Methods of modifying a polypeptide are routine to those of skill in the art, such as by using recombinant DNA methodologies.

As used herein, suitable conservative substitutions of amino acids are known to those of skill in the art and can be made generally without altering the biological activity of the resulting molecule. Those of skill in the art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |

TABLE 2-continued

| Original residue | Exemplary conservative substitution |
| --- | --- |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified soluble PH20 . refers to preparations of proteins that are substantially free of cellular material includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as a contaminating protein), generally less than about 20% of non-enzyme proteins or 10% of non-enzyme proteins or less than about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein the term "assessing" is intended to include quantitative and qualitative determination in the sense of obtaining an absolute value for the activity of a protein, such as an enzyme, or a domain thereof, present in the sample, and also of obtaining an index, ratio, percentage, visual or other value indicative of the level of the activity. Assessment can be direct or indirect. For example, the chemical species actually detected need not of course be the enzymatically cleaved product itself but can for example be a derivative thereof or some further substance. For example, detection of a cleavage product can be a detectable moiety such as a fluorescent moiety.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a hyaluronidase enzyme is its degradation of hyaluronic acid.

In other examples, a biological activity of a BPH therapeutic agent includes its mechanism of action and its reduction of one or more symptoms associated with BPH.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, "disease or disorder" refers to a pathological condition in an organism resulting from cause or condition including, but not limited to, infections, acquired conditions, genetic conditions, and characterized by identifiable symptoms.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease.

As used herein, treatment means any manner in which the symptoms of a condition, disorder or disease or other indication, are ameliorated or otherwise beneficially altered.

As used herein, a therapeutic agent refers to any agent that is capable of providing a therapeutic effect when administered to a subject. For example, for treatment of benign prostatic hyperplasia, a therapeutic agent is any agent that effects reduction in prostate volume, growth or size, and in some instances shrinkage of the prostate.

As used herein, hydrophobic agent or drug is an agent that does not readily absorb or dissolve into water or other aqueous solution, and that is generally not soluble in aqueous solutions. Various methods are known in the art to determine the hydrophobicity of a drug or agent (Wasik et al. (1981) NBS Techn. Rep., 81:S1-56; Sangster J. A Databank of evaluated octanol-water partition coefficients (Log P), logkow.cisti.nrc.ca/logkow/). For example, the octanol/water partition coefficient (log $P_{o/w}$) can be determined which is a ratio of the equilibrium concentration of a substance dissolved in a two-phase system, formed by two immiscible solvents (water and a hydrophobic solvent such as octanol). This can be performed using high performance liquid chromatography (HPLC).

As used herein, a hydrophilic agent or drug is an agent that can readily absorb or dissolve into water or other aqueous solution. A partition coefficient measurement as described above also can be used to measure how hydrophilic a drug or agent is.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject. A therapeutically effective amount is the dosage sufficient to reduce one or more symptoms of BPH in a subject for at least a week, more preferably a month and most preferably 6 to 8 months or longer. Indicators of improvement or successful treatment include the reduction in the size of the obstructive prostatic tissue and alleviation of symptoms of urinary obstruction.

As used herein, the term "subject" refers to an animal, including a mammal, such as a human being.

As used herein, a patient refers to a human subject exhibiting symptoms of a disease or disorder.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass a hyaluronidase, e.g. a soluble PH20, and one or more of an anti-androgen, alpha blocking agent and a *boutlinum* toxin contained in the same or separate articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a combination of compositions provided herein and another item for a purpose including, but not limited to, reconstitution, activation, and instruments/devices for delivery, administration, diagnosis, and assessment of a biological activity or property. Kits optionally include instructions for use.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The hyaluronidases provided herein are from any source, animal, plant, prokaryotic and fungal. Most hyaluronidases are of animal origin, including mammalian origin. Generally hyaluronidases are of human origin.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, a hyaluronan-associated disease, disorder or condition refers to any disease or condition in which hyaluronan levels are elevated as cause, consequence or otherwise observed in the disease or condition. Hyaluronan-associated diseases and conditions are associated with elevated hyaluronan expression in a tissue or cell, increased interstitial fluid pressure, decreased vascular volume, and/or increased water content in a tissue. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein "Benign Prostatic Hyperplasia" or Hypertrophy" (BPH) refers to a disease or condition of the prostate gland wherein the prostate is enlarged or exhibits hyperplasia and which is not a malignant disease or condition.

As used herein, reference to an agent that is suitable for treatment of benign prostatic hyperplasia refers to any agent that effects a reduction in prostate volume or growth when administered to a subject, and in some instances effects shrinkage of the prostate. Such agents include, but are not limited to, anti-androgens, alpha blockers, *boutlinum* toxins. Such agents are well-known to one of skill in the art. Exemplary agents are described herein.

As used herein, "anti-androgen" refers to a broad class of agents that exert their effect by either interfering with the binding of androgens to the androgen receptor or interfering with the production of androgens. Anti-androgens that act through the androgen receptor are classified as steroidal or non-steroidal anti-androgens based on their chemical structure. Steroidal anti-androgens have the structure of a steroid, i.e., they are tetracyclic hydrocarbons comprised of three cyclohexane and one cyclopentane ring. Non-steroidal anti-androgens do not have the chemical structure of a steroid. An example of an anti-androgen that interferes with the production of androgens is a 5α-reductase inhibitor.

As used herein, "alpha blocking agent" refers to an agent that interferes with or prevents the stimulation of alpha1-adrenoreceptors and acts to relax the smooth muscle tissue found in the prostate and the bladder neck, allowing urine to flow out of the bladder more easily.

As used herein, "5α-reductase inhibitor" refers to an agent that inhibits the enzyme 5α-reductase such that testosterone is not converted to 5α-dihydrotestosterone.

As used herein, "*boutlinum* toxin" refers to the neurotoxin produced by *Clostridium boutlinum*; the *boutlinum* toxin (or the light chain or the heavy chain) made recombinantly by a non-Clostridial species; the *boutlinum* toxin serotypes A, B, C, D, E, F and G; a *boutlinum* toxin complex (the 300, 600 and 900 kDa complexes); a modified *boutlinum* toxin, PEGylated *boutlinum* toxin, chimeric *boutlinum* toxin, recombinant *boutlinum* toxin, hybrid *boutlinum* toxin and chemically-modified *boutlinum* toxin. A modified botulism toxin is a botulism toxin that has at least one of its amino acids deleted, modified, or replaced, as compared to a native *boutlinum* toxin. A modified *boutlinum* toxin can be a recombinantly produced neurotoxin, or derivative or fragment of a recombinantly made neurotoxin. A modified *boutlinum* toxin retains at least one biological activity of the native *boutlinum* toxin.

As used herein, "intraprostatically" refers to directly into the prostate by injection or infusion and includes, but is not limited to, transurethral, transperineal, and transrectal administration.

As used herein "extended or sustained release" or "controlled release formulation" refers the formulation of a pharmaceutical composition of one or more therapeutic agents that after localized injection into the prostate allows for the therapeutic agent(s) to be released from the pharmaceutical composition, so as to contact surrounding cells and tissues, over a period of time, as opposed to all at once, between 1 day and about 1 year. Therapeutic agents are thus delivered to prostate cells and to surrounding cells and tissues over a period of time (hours, days, weeks, months) rather than immediately. Sustained release formulations include, but are not limited to, lipid vesicles including unilamellar vesicles (LUV) and multilamellar vesicles (MLV), drug-resin complexes (resinates), and depot formulations.

As used herein "hydrolytic enzyme" refers to hydrolytic enzymes that can be used to digest or dissolve prostatic tissue, including but not limited to, collagenase, hyaluronidase, trypsin, chymotrypsin, pronase, elastase, DNase I, dispase, plasmin, bromelin, clostripain, thermolysin, neuraminidase, phospholipase, cholesterol esterase, subtilisin, papain, chymopapain, plasminogen activator, streptokinase, urokinase, fibrinolysin, serratiopeptidase, pancreatin, amylase, lysozyme, cathepsin-G, and the PMN leukocyte serine proteases.

As used herein, "total activity" refers to the enzymatic activity of the active agent, for example, the hyaluronan degrading enzyme, that is encapsulated within the liposome.

As used herein, "multivesicular liposome" or "lipid membrane vesicle" or "liposome" refers to man-made, microscopic lipid vesicles containing lipid membranes enclosing multiple non-concentric aqueous chambers. A multivesicular liposome, as used herein, is a water-in-oil-in-water (w/o/w) emulsion.

As used herein, "volatile organic solvent" refers to an organic solvent that is readily evaporated. Exemplary volatile organic solvents include, but are not limited to, ethers, halogenated ethers, hydrocarbons, esters, halogenated hydrocarbons, or Freons, for example, diethyl ether, isopropyl and other ethers, chloroform, tetrahydrofuran, ethyl acetate, Forane and combinations thereof.

As used herein, "neutral lipid" refers to an oil or fat that has no membrane-forming capability by itself and lacks a hydrophilic "head" group. Examples of neutral lipids include diglycerides, such as diolefin, dipalmitolein; propylene glycol esters such as mixed diesters of caprylic/capric acids on propylene glycol; triglycerides such as triolein, tripalmitolein, trilinolein, tricaprylin and trilaurin; vegetable oils, such as soybean oil; lard or beef fat; squalene; tocopherol; and combinations thereof. Neutral lipids include both slow release neutral lipids and fast release neutral lipids. Slow release neutral lipids include, for example, triolein, tripalmitolein, trimyristolein, trilaurin, and tricaprin. Fast release neutral lipids include, for example, tricaprylin and tricaproin and mixtures thereof.

As used herein, "amphipathic lipid" refers to a molecule that has a hydrophilic "head" group and a hydrophobic "tail" group and has membrane-forming capacity. Amphipathic lipids include those with net negative charge, zero net charge, and net positive charge at pH 7.4, including zwitterionic, acidic or cationic lipids. Such exemplary amphipathic lipids include, but are not limited to, phosphatidylglycerol (PG), cardiolipin (CL), phosphatidylserine (PS), phosphatidic acid (PA), phosphatidylinositol, phosphatidylcholine (PC), phosphatidylethanolamine (PE), sphingomyelin, diacyl trimethylammoniumpropane (DITAP) and combinations thereof.

As used herein, "long chain amphipathic lipid" refers to an amphipathic lipid having an increased number of carbons in the carbon chain, including but not limited to DOPC or DC18:1  PC=1,2-dioleoyl-sn-glycero-3-phosphocholine; DLPC or DC12:0 PC=1,2-dilauroyl-sn-glycero-3-phosphocholine; DMPC or DC14:0 PC=1,2-dimyristoyl-sn-glycero-3-phosphocholine; DPPC or DC16:0 PC=1,2-dipalmitoyl-sn-glycero -3-phosphocholine; DSPC or DC18:0 PC=1,2-distearoyl-sn-glycero-3-phosphocholine; DAPC or DC20:0 PC=1,2diarachidoyl-sn-glycero-3-phosphocholine; DBPC or DC22:0 PC=1,2-dibehenoyl-sn-glycero-3-phosphocholine; DC16:1 PC=1,2-dipalmitoleoyl-sn-glycero-3-phosphocholine; DC20:1 PC=1,2-dieicosenoyl-sn-glycero -3-phosphocholine; DC22:1 PC=1,2-dierucoyl-sn-glycero-3-phosphocholine; DPPG=1,2-dipalmitoyl-sn-glycero-3-phosphoglycerol; DOPG=1,2-dioleoyl-sn-glycero -3-phosphoglycerol. Typically, use of a long chain amphipathic lipid will increase the encapsulation efficiency of the liposomal formulation.

As used herein, "hyaluronic acid" or "HA" refers to a non-sulfated glycosaminoglycan that is widely distributed throughout connective, epithelial, and neural tissues. It is a polymer of up to 25,000 disaccharide units, themselves composed of D-glucuronic acid and D-N-acetylglucosamine. The molecular weight of HA ranges from about 5 kDa to 20,000 kDa. Hyaluronic acid oligomers as used herein are fragments of hyaluronic acid.

As used herein, "stable" or "stability" with reference to a hyaluronan-degrading enzyme or composition containing a hyaluronan-degrading enzyme means that the hyaluronan-degrading enzyme retains at least a requisite level of its activity of at least 50% of the hyaluronan-degrading enzyme activity under defined conditions, for example, temperature conditions of low or refrigerated temperatures of 2° C. to 8° C., ambient temperatures of 20° C. to 30° C. or elevated temperatures of 32° C. to 40° C. for a period of time of greater than 6 months. For example, the hyaluronan-degrading enzyme retains at least 60%, 70%, 80%, 85%, 90%, 95% or more of its activity at a temperature of 2° C. to 8° C., 20° C. to 30° C. or 32° C. to 40° C. for a period of time of greater than 6 months.

As used herein, "active agent" or "biologically active agent" when used to describe agents present in the chambers of the multivesicular liposome or in the aqueous solution used during manufacture of liposomes, includes agents which possess a desired biological activity, including but not limited to hyaluronan degrading enzymes, drugs and prodrugs, small molecules and proteins.

As used herein, "osmolarity" refers to the sum of the molar concentrations of solutes present in the aqueous solution, including any added excipients.

As used herein, an "excipient" refers to any molecule, agent or compound that maintains or enhances the stability of a hyaluronan degrading enzyme, or modulates (increases) encapsulation efficiency of the hyaluronan degrading enzyme. Excipients are known to one of skill in the art or can be empirically determined. Exemplary excipients are described herein.

As used herein, "osmotic excipient" refers to a biologically compatible solute molecule in an aqueous solution that is not the biologically active agent. An osmotic excipient can be used to alter the osmolarity of the aqueous component into which the active agent is dissolved for encapsulation. Both electrolytes and non-electrolytes function as osmotic excipients. When determining whether any particular molecule will function as an osmotic excipient or when determining the concentration of an osmotic excipient in a solution, for example, one encapsulated in a multivesicular liposome, consideration must be given to whether, under conditions within the solution, for example, pH, the molecule is partially or wholly ionized. Osmotic excipients include those that can facilitate the activity of the active agent. Osmotic excipients that can be used to form multivesicular liposomes and to modulate the drug loading of the encapsulated agent from multivesicular liposomes include, but are not limited to, glucose, sucrose, trehalose, succinate, glycylglycine, gluconic acid, cyclodextrin, arginine, galactose, mannose, maltose, mannitol, glycine, lysine, citrate, sorbitol, dextran and combinations thereof.

As used herein, "stabilizer" refers to an excipient, that when added to a multivesicular liposome, stabilizes the active agent.

As used herein, "depot gel" or "depot formulation" refers to a gel formulation that permits sustained release of an active agent. Generally, the gel is a hydrogel, a gel that contains a substantial amount of water, it is biocompatible and the gel is biodegradable. Gel-forming materials include, but are not limited to, polysaccharides such as alginate and modified forms thereof, other polymeric hydrogel precursors include polyethylene oxide-polypropylene glycol block polymers such as Pluronics® or Tetronics®.

As used herein, "encapsulation efficiency" or "percent encapsulation" refer to the ratio of the amount of compound to be encapsulated in the final suspension of the liposome to the total amount of compound to be encapsulated used in the first aqueous solution of the process multiplied by 100.

As used herein, "drug loading capacity" refers to the amount of the active agent, i.e., the hyaluronan degrading enzyme, loaded into the product liposome suspension. Drug loading capacity is a measure of the amount of active agent available in a unit volume of liposome formulation and is the ratio of encapsulated drug per unit volume of liposome suspension to the percent encapsulated volume in the liposomes themselves. It is approximately equal to the concentration of the active agent in the suspension divided by the lipocrit of the suspension for low percent free drug.

As used herein, "lipocrit" refers to the ratio of volume occupied by the liposomes to the total suspension volume multiplied by 100.

As used herein, "percent free drug" refers to the ratio of the amount of drug exterior to the liposomes in the final liposome suspension to the total amount of drug in the final suspension multiplied by 100.

As used herein "other agents useful for treating BPH" refers to agents other than anti-androgens, alpha blocking agents and *boutlinum* toxin.

As used herein, the singular forms "a," "an" and "the" include plural referents unless the context clearly dictates otherwise. Thus, for example, reference to a compound containing "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Overview—Accumulated Hyaluronan (HA) in Disease and Hydrolysis Thereof

Provided herein are compositions contained sustained release formulations, such as lipid formulations, of a hyaluronan-degrading enzyme. Hyaluronan-degrading enzymes can be used in methods of treating hyaluronan (HA)-associated diseases or conditions in which elevated or accumulated hyaluronan levels are a cause or otherwise associated with the disease or condition. It is found, however, that a problem with the use of hyaluronan-degrading enzymes to degrade HA at local tissue sites is that, once administered, hyaluronan-degrading enzymes disappear rapidly. In contrast, cells that make HA are regenerated every 3 to 10 days. Thus, it is found herein that sustained or controlled release of a hyaluronan-degrading enzyme can be used to provide a continual or persistent source of enzyme to degrade HA at local sites, such as at stromal cells of the prostate, to provide prolonged focal hydrolysis of HA. Hence, as described herein, the sustained-release formulations of a hyaluronan-degrading enzyme can be provided to promote localization of the enzyme, to provide high concentration of enzyme at the target site, e.g. prostate gland, and/or to provide for extended release of the enzyme at the target site.

In particular, hyaluronan (HA) accumulation in the stroma is a characteristic of BPH. Hence, the compositions containing sustained release formulations, and combinations thereof, are useful for the treatment of benign prostatic hyperplasia (BPH), in particular in men with an enlarged prostate. It is found herein that hyaluronan degrading enzymes, e.g., hyaluronidases, when provided to the hypertrophied prostate gland, degrade the hyaluronic acid that accumulates in the stroma of the hypertrophied gland and causes apoptosis of cells present in the stroma of the gland. Depletion of HA in the stroma results in selective apoptosis of stromal cells that are stimulated by testosterone, while normal stromal cells are unaffected. The apoptosis of stromal cells halts stromal expansion and results in prostate shrinkage and reduces or halts BPH progression. Thus, exposure of the hypertrophied prostate gland to hyaluronidase results in a decrease in the size of the hypertrophied gland and an inhibition of further proliferation. In particular, the effect of hyaluronan-degrading enzymes is selective for stromal cells stimulated by testosterone, and it does not cause apoptosis of epithelial cell that could result in undesirable outcomes such as organ dysfunction. Hence, the use of hyaluronan-degrading enzymes is safe and is not associated with tissue-related side effects.

For the treatment of BPH, sustained release formulations containing a hyaluronan degrading enzyme, such as hyaluronidase, can be directly injected into the prostate gland. The hyaluronan-degrading enzyme composition can be formulated as a depot so as to be released over an extended period of time once introduced into the prostate. Such methods of administration are beneficial as they reduce side effects by minimizing the exposure of tissues and organs other than the prostate to these agents, permit therapeutic agents to achieve a high local concentration and extend the time that the prostate and surrounding cells and tissues are exposed to the therapeutic agents.

The use of hyaluronan degrading enzymes represents a previously unrecognized method for treating BPH. This effect of hyaluronan degrading enzymes on the hypertrophied prostate is distinct from their use as a spreading agent. For example, known uses of hyaluronan degrading enzymes include use as spreading agents to enhance the effect of a therapeutic agent by facilitating access of the therapeutic agent to its target.

Treatment of BPH with hyaluronan-degrading enzymes exhibits efficacious properties that are not exhibited by existing treatments of BPH. For example, existing treatments using alpha blockers or 5-alpha-reductase-inhibitors have limitations. While alpha blockers, such as finasteride, relieve symptoms, they do not reduce prostate size or impact progression. In addition, although 5-alpha-reductase inhibitors shrink the prostate, they can take more than 6 months to work, patients can become refractory and sexual side effects are common. Further, other methods of treating BPH that involve surgery, such as transurethral resection of the prostate (TURP) or other interventional surgeries, are associated with unwanted side effects that can include, for example, retrograde ejaculation, infection and urethral narrowing. In contrast, treatment of BPH with a hyaluronan-degrading enzymes, for example hyaluronidase such as a PH20, results in rapid reduction in prostate volume, no sexual side effects and no side effects associated with surgery.

In some examples, the composition or formulations containing a hyaluronan-degrading enzyme can be combined in combination treatments with one or more other agents useful for the treatment of benign prostatic hyperplasia. Such other agents include, but are not limited to, anti-androgens, alpha blocking agents, *boutlinum* toxin and any other type of agent useful for the treatment of BPH. The other agents can be administered separately or can be co-administered in a sustained release formulation with a hyaluronan-degrading enzyme. Combination of hyaluronidase as a therapeutic agent for BPH and other complementary BPH therapeutic agents can result in an enhanced ability to reduce the size of the hypertrophied gland for an extended period of time, thus potentially achieving a greater therapeutic effect than observed when a therapeutic agent is used alone.

The sections below provide non-limiting description of hyaluronan-degrading enzymes, sustained release formulations, combination treatments and method and uses of such, for example, for treating BPH.

C. Hyaluronan Degrading Enzymes

Provided herein are compositions and formulations containing hyaluronan degrading enzymes, including sustained or controlled release formulations. The compositions containing sustained release formulations can be used in local injections to circumvent HA accumulation associated with disease. For example, such compositions and formualtions can be used in methods for treatment of benign prostatic hyperplasia by degrading stromal-associated HA. Hyaluronan degrading enzymes, such as hyaluronidases, can be utilized as BPH therapeutic agents to reduce the size of hypertrophied prostate tissue and also prevent further proliferation.

Hyaluronan, also called hyaluronic acid or hyaluronate, is a non-sulfated glycosaminoglycan that is widely distributed throughout connective, epithelial, and neural tissues. Hyaluronan is an essential component of the extracellular matrix and a major constituent of the interstitial barrier. By catalyzing the hydrolysis of hyaluronan, hyaluronan degrading enzymes lower the viscosity of hyaluronan, thereby increasing tissue permeability and increasing the absorption rate of fluids administered parenterally. As such, hyaluronan degrading enzymes, such as hyaluronidases, have been used, for example, as spreading or dispersing agents in conjunction with other agents, drugs and proteins to enhance their dispersion and delivery. Hyaluronan-degrading enzymes also are used as an adjuvant to increase the absorption and dispersion of other injected drugs, for hypodermoclysis (subcutaneous fluid administration), and as an adjunct in subcutaneous urography for improving resorption of radiopaque agents. Hyaluronan-degrading enzymes, for example, hyaluronidase can be used in applications of ophthalmic procedures, for example, peribulbar and sub-Tenon's block in local anesthesia prior to ophthalmic surgery. Hyaluronidase also can be use in other therapeutic and cosmetic uses, for example, by promoting akinesia in cosmetic surgery, such as blepharoplasties and face lifts.

Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating β-1→4 and β-1→3 glycosidic bonds. Hyaluronan chains can reach about 25,000 disaccharide repeats or more in length and polymers of hyaluronan can range in size from about 5,000 to 20,000,000 Da in vivo. Accordingly, hyaluronan degrading enzymes in the formulations herein include any enzyme having the ability to catalyze the cleavage of a hyaluronan disaccharide chain or polymer. In some examples the hyaluronan degrading enzyme cleaves the β-1→4 glycosidic bond in the hyaluronan chain or polymer. In other examples, the hyaluronan degrading enzyme catalyze the cleavage of the β-1→3 glycosidic bond in the hyaluronan chain or polymer.

Hyaluronan-degarding enzymes for use in the formulations, methods and combinations herein include, for example, hyaluronidases and chrondroitinases, and soluble forms thereof that lack all or a portion of a GPI anchor and are secreted from cells. A description of various hyaluronandegarding enzymes is provided below. It is understood that any hyaluronan-degrading enzyme that degrade or cleave HA, and in particular any that degrade the hyaluronic acid that accumulates in the stroma of the hypertrophied prostate gland, can be used in the formulations and methods herein. In particular, the hyaluron-degrading enzyme is a PH20, such as a human PH20 and in particular a C-terminal truncated PH20. Where the methods and uses provided herein describe the use of a soluble hyaluronidase, accordingly any hyaluronan degrading enzyme, generally a soluble hyaluronan degrading enzyme, can be used. It is understood that any hyaluronidase can be used in the methods and uses provided herein (see, e.g., U.S. Publication Nos. US20040268425 and US20100143457).

In particular, the hyaluronan-degrading enzyme is a soluble enzyme that is secreted from cells upon expression. For example, exemplary hyaluronan-degrading enzymes provided herein contain C-terminal truncations to remove all or part of the GPI anchor. In particular examples, the hyaluronan-degrading enzyme is a PH20 enzyme. The hyaluronan-degrading enzyme also can be further modified, for example, to further extend its half-life.

Typically, for use in the compositions, formulations, combinations and methods herein, a soluble human hylauronan degrading enzyme, such as a soluble human PH20, is used. Although hylauronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

If glycosylation of a hyaluronidase is required for activity, generally hyaluronan-degrading enzymes are produced using protein expression systems that facilitate correct N-glycosylation to ensure the polypeptide retains activity. For example, glycosylation is important for the catalytic activity and stability of hyaluronidases such as human PH20, Such cells include, for example Chinese Hamster Ovary (CHO) cells (e.g. DG44 CHO cells).

1. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Such enzymes can be used in the compositions, formulations, combinations and methods provided.

a. Mammalian-Type Hyaluronidases

Mammalian-type hyaluronidases (EC 3.2.1.35) are endo-β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS:10, 11 and 64 and BH55 (U.S. Pat. Nos. 5,747,027 and 5,827,721)), sheep (ovis aries) (SEQ ID NO: 26, 27, 63 and 65), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), orangutan (SEQ ID NO:28), *cynomolgus* monkey (SEQ ID NO:29), guinea pig (SEQ ID NO:30), chimpanzee (SEQ ID NO:101), *rhesus* monkey (SEQ ID NO:102), and human hyaluronidases.

Exemplary of hyaluronidases in the compositions, combinations and methods provided herein are soluble hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NO:27), bovine (SEQ ID NO:11) and human (SEQ ID NO:1). Human PH20 (also known as SPAM1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and PH20 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e. pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova, et al. (2003) Proc Natl Acad Sci USA 100(8):4580-5), and those which are generally soluble such as human HYAL1 (Frost et al. (1997) *Biochem Biophys Res Commun.* 236(1):10-5).

i. PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. They have both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins include, but are not limited to, human (precursor polypeptide set forth in SEQ ID NO:1, mature polypeptide set forth in SEQ ID NO: 2), chimpanzee (SEQ ID NO:101), *Rhesus* monkey (SEQ ID NO:102) bovine (SEQ ID NOS: 11 and 64), rabbit (SEQ ID NO: 25), ovine PH20 (SEQ ID NOS: 27, 63 and 65), *Cynomolgus* monkey (SEQ ID NO: 29), guinea pig (SEQ ID NO: 30), rat (SEQ ID NO: 31) and mouse (SEQ ID NO: 32) PH20 polypeptides.

Bovine PH20 is a 553 amino acid precursor polypeptide (SEQ ID NO:11). Alignment of bovine PH20 with the human PH20 shows only weak homology, with multiple gaps existing from amino acid 470 through to the respective carboxy termini due to the absence of a GPI anchor in the bovine polypeptide (see e.g., Frost G I (2007) *Expert Opin. Drug. Deliv.* 4: 427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-36).

The structure of bovine hyaluronidase has permitted the use of the soluble bovine testes hyaluronidase enzyme as an extract for clinical use (Wydase®, Hyalase®). Other animal-derived PH20 hyaluronidase preparations include Vitrase® (ISTA Pharmaceuticals), a purified ovine testicular hyaluronidase, Amphadase® (Amphastar Pharmaceuticals), a bovine testicular hyaluronidase and Hydase (Akorn), a bovine testicular hyaluronidase.

ii. Human PH20

The human PH20 mRNA transcript is normally translated to generate a 509 amino acid precursor polypeptide (SEQ ID NO:1) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 is, therefore, a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Human PH20 exhibits hyaluronidase activity at both neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at both neutral and acid pH. It appears that PH20 contains two catalytic sites at distinct regions of the polypeptide: the Peptide 1 and Peptide 3 regions (Cherr et al., (2001) *Matrix Biology* 20:515-525). Evidence suggests that the Peptide 1 region of PH20, which corresponds to amino acid positions 107-137 of the mature polypeptide set forth in SEQ ID NO:2 and positions 142-172 of the precursor polypeptide set forth in SEQ ID NO:1, is required for enzyme activity at neutral pH. Amino acids at positions 111 and 113 (corresponding to the mature PH20 polypeptide set forth in SEQ ID NO:2) within this region appear to be important for activity, as mutagenesis by amino acid replacement results in PH20 polypeptides with 3% hyaluronidase activity or undetectable hyaluronidase activity, respectively, compared to the wild-type PH20 (Arming et al., (1997) *Eur. J. Biochem.* 247: 810-814).

The Peptide 3 region, which corresponds to amino acid positions 242-262 of the mature polypeptide set forth in SEQ ID NO:2, and positions 277-297 of the precursor polypeptide set forth in SEQ ID NO: 1, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) *Eur. J. Biochem.* 247:810-814).

In addition to the catalytic sites, PH20 also contains a hyaluronan-binding site. Experimental evidence suggest that this site is located in the Peptide 2 region, which corresponds to amino acid positions 205-235 of the precursor polypeptide set forth in SEQ ID NO: 1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) *Eur. J. Biochem.* 247:810-814).

There are seven potential N-linked glycosylation sites in human PH20 at N82, N166, N235, N254, N368, N393, N490 of the polypeptide exemplified in SEQ ID NO: 1. Because amino acids 36 to 464 of SEQ ID NO:1 appears to contain the minimally active human PH20 hyaluronidase domain, the N-linked glycosylation site N-490 is not required for proper hyaluronidase activity. There are six disulfide bonds in human PH20. Two disulfide bonds between the cysteine residues C60 and C351 and between C224 and C238 of the polypeptide exemplified in SEQ ID NO: 1 (corresponding to residues C25 and C316, and C189 and C203 of the mature polypeptide set forth in SEQ ID NO:2, respectively). A further four disulfide bonds are formed between the cysteine residues C376 and C387; between C381 and C435; between C437 and C443; and between C458 and C464 of the polypeptide exemplified in SEQ ID NO: 1 (corresponding to residues C341 and C352; between C346 and C400; between C402 and C408; and between C423 and C429 of the mature polypeptide set forth in SEQ ID NO:2, respectively).

Unlike most animal preparations of PH20, human PH20 contains a GPI anchor that anchors the expressed protein to the cell-membrane. Typically, therapeutic preparations of human PH20 are provided as souble polypeptides lacking C-terminal amino acid residues. Exemplary soluble hyaluronidases, including soluble PH20 hyaluronidases, are described below. Preparations of human PH20 include Hylenex® and Enhanze™ Technology.

b. Bacterial Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β3-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria include, but are not limited to, hyaluronan degrading enzymes in microorganisms, including strains of *Arthrobacter, Bdellovibrio, Clostridium, Micrococcus, Streptococcus, Peptococcus, Propionibacterium, Bacteroides*, and *Streptomyces*. Particular examples of such enzymes include, but are not limited to *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73)), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81)), *Streptococcus pneumoniae* ((SEQ ID NO:82); strain ATCC BAA-255/R6 (SEQ ID NO:83); serotype 2, strain D39/NCTC 7466 (SEQ ID NO:84)), *Streptococcus pyogenes* ((serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92)); *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607).

c. Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of 1→3-linkages between β-D-glucuronate and N-acetyl-D-glucosamine residues in hyaluronate. Exemplary hyaluronidases from leeches include, but are not limited to, hyaluronidase from Hirudinidae (e.g., *Hirudo medicinalis*), Erpobdellidae (e.g., *Nephelopsis obscura* and *Erpobdella punctata*,), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

2. Other Hyaluronan Degrading Enzymes

In addition to the hyaluronidase family, other hyaluronan degrading enzymes can be used in the compositions, formulations, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, formulations, combinations, and methods provided are known in the art (e.g., U.S. Pat. No. 6,054,569; Yamagata, et al. (1968) *J. Biol. Chem.* 243(7):1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol. Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272: 9123-9130). A exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO: 98 (Sato et al. (1994) *Appl. Microbiol. Biotechnol.* 41(1):39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS:99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133)

3. Soluble Hyaluronan Degrading Enzymes

In particular examples, hyaluronan-degrading enzymes are provided as soluble enzymes that can be secreted from cells upon expression. Hence, soluble enzymes include enzymes that, when expressed, are secreted into the cell media where they can be isolated or purified. As described above, hyaluronan-degrading enzymes exist in membrane-bound or soluble forms that are secreted from cells. Thus, where hyaluronan-degrading enzymes include a glycosylphosphatidylinositol (GPI) anchor and/or are otherwise membrane-anchored or insoluble, such hyaluronan-degrading enzymes are provided herein in soluble form by truncation or deletion of all or a portion of the GPI anchor to render the enzyme secreted and soluble. One of skill in the art can determine whether a polypeptide is GPI-anchored using methods well known in the art. Such methods include, but are not limited to, using known algorithms to predict the presence and location of the GPI-anchor attachment signal sequence and ω-site, and performing solubility analyses before and after digestion with phosphatidylinositol-specific phospholipase C (PI-PLC) or D (PI-PLD). In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods herein is a soluble neutral active hyaluronidase. Assays to assess the activity of hyaluronidase at various pH conditions, including at neutral pH, are well known to one of skill in the art.

Thus, hyaluronan-degrading enzymes include truncated variants, e.g. truncated variants within the C-terminus of the polypeptide to remove all or a portion of a GPI anchor. Such enzymes include, but are not limited to, soluble hyaluronidases, including non-human soluble hyaluronidases, bacterial soluble hyaluronidases and human hyaluronidases, Hyal1, bovine PH20 and ovine PH20, allelic variants thereof and other variants thereof. Exemplary of a soluble hyaluronidase is PH20 from any species, such as any set forth in any of SEQ ID NOS: 1, 2, 11, 25, 27-32, 63-65 and 101-102, variants thereof that exhibit at least 85%, 90%, 91%, 92%, 93%, 94%, 95% or more sequence identity to any of SEQ ID NOS: 1, 2, 11, 25, 27-32, 63-65 and 101-102, or truncated forms thereof lacking all or a portion of the C-terminal GPI anchor, so long as the hyaluronidase is secreted from cells into the media upon expression therefrom and retains hyaluronidase activity. Soluble hyaluronan-degrading enzyme provided herein can be truncated within the C-terminus by at least or 1, 2, 3, 4, 5, 6, 7, 8, 9, 10, 15, 20, 30, 40, 50, 60 or more amino acids compared to the wild type polypeptide so long as the resulting truncated polypeptide exhibits hyaluronidase activity. For example, the minimal hyaluronidase domain of human PH2O required for activity is amino acids 36-464 (see e.g. U.S. Pat. No. 7,767,429). Thus, in a human PH20 hyaluronidase, at least 45 amino acids can be removed from the C-terminus. The hyaluronidase activity can be between or about 0.5% to 100% of the activity of the starting polypeptide, for example, at least 5%, 10%, 20%, 30%, 40%, 50%, 60%, 70%, 80%, 90% or more of the activity of the hyaluronan-degrading enzyme containing the GPI anchor.

In instances where the soluble hyaluronan degrading enzyme retains a portion of the GPI anchor attachment signal sequence, at least or 1, 2, 3, 4, 5, 6, 7 or more amino acid residues in the GPI-anchor attachment signal sequence can be retained, provided the polypeptide can be isolated from cell medium upon expression, e.g. loosely attached to the cell membrane or secreted from cells into the media upon expression therefrom. Polypeptides containing one or more amino acids of the GPI anchor are termed extended soluble hyaluronan degrading enzymes (see e.g. published U.S. application No. 2010-0143457 for exemplary extended soluble hyaluronan-degarding enzymes).

a. Soluble Human PH20

Exemplary of a soluble hyaluronidase is soluble human PH20, Soluble forms of recombinant human PH20 have been produced and can be used in the compositions, formulation, combinations and methods described herein. The production of such soluble forms of PH20 is described in U.S. Published Patent Application Nos. US20040268425; US 20050260186 and US20060104968 and International PCT application No. WO2009111066.

Exemplary C-terminally truncated human PH20 polypeptides provided herein include any having aC-terminal amino acid residue 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO: 1, or corresponding positions in an allelic or species variant thereof or other variant. When expressed in mammalian cells, the 35 amino acid N-terminal signal sequence is cleaved during processing, and the mature form of the protein is secreted. Thus, exemplary mature C-terminally truncated soluble PH20 polypeptides can contain amino acids 36 to 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO: 1 or corresponding positions in an allelic or species variant thereof or other variants. For example, exemplary truncated C-terminally PH20 polypeptides for use in the compositions and formulations provided herein are any that exhibit at least 85%, 90%, 91%, 92%, 93%, 94%, 95% or more sequence identitity to amino acids 36 to 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499 or 500 of the sequence of amino acids set forth in SEQ ID NO: 1 It is understood that variablity in amino acid residues N-terminus of the polypeptide can exist due to varied processing of the polypeptide in cells. In addition, a heterologous signal sequence can be used to alter or improve expression of the encoding nucleic acid in cells.

Table 3 provides non-limiting examples of exemplary C-terminally truncated PH20 polypeptides, including C-terminally truncated soluble PH20 polypeptides. In Table 3 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 3 for comparison. Such exemplary C-terminally truncated PH20 polypeptides include any set forth any of SEQ ID NOS: 4-9, 47, 48, 151-170, 185-189, 242, 275 or 276, or a polypeptide that exhibits at least 85%, 90%, 91%, 92%, 93%, 94%, 95% or more sequence identitity to any of SEQ ID NOS: 4-9, 47, 48, 151-170, 185-189, 242, 275 or 276.

In particular, exemplary of such polypeptides are those generated from a nucleic acid molecule encoding amino acids 1-482 of SEQ ID NO:1 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS:4-9 in various abundance. Typically, rHuPH20 is produced in cells that facilitate correct N-glycosylation to retain activity, such as CHO cells (e.g. DG44 CHO cells).

TABLE 3

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-SILF | 500 | 231 | 465 | 275 |
| SPAM-VSIL | 499 | 198 | 464 | 242 |
| SPAM1-IVSI | 498 | 232 | 463 | 276 |
| SPAM1-FIVS | 497 | 107 | 462 | 151 |
| SPAM1-MFIV | 496 | 141 | 461 | 185 |
| SPAM1-TMFI | 495 | 108 | 460 | 152 |
| SPAM1-ATMF | 494 | 142 | 459 | 186 |
| SPAM1-SATM | 493 | 109 | 458 | 153 |
| SPAM1-LSAT | 492 | 143 | 457 | 187 |
| SPAM1-TLSA | 491 | 110 | 456 | 154 |
| SPAM1-PSTL | 489 | 111 | 454 | 155 |
| SPAM1-SPST | 488 | 144 | 453 | 188 |
| SPAM1-STLS | 490 | 112 | 455 | 156 |
| SPAMI-ASPS | 487 | 113 | 452 | 157 |
| SPAM1-NASP | 486 | 145 | 451 | 189 |
| SPAM1-YNAS | 485 | 114 | 450 | 158 |
| SPAM1-FYNA | 484 | 115 | 449 | 159 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |
| SPAM1-TEEP | 478 | 42 | 443 | 8 |
| SPAM1-ETEE | 477 | 41 | 442 | 9 |

TABLE 3-continued

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| SPAM1-METE | 476 | 116 | 441 | 160 |
| SPAM1-PMET | 475 | 117 | 440 | 161 |
| SPAM1-PPME | 474 | 118 | 439 | 162 |
| SPAM1-KPPM | 473 | 119 | 438 | 163 |
| SPAM1-LKPP | 472 | 120 | 437 | 164 |
| SPAM1-FLKP | 471 | 121 | 436 | 165 |
| SPAM1-AFLK | 470 | 122 | 435 | 166 |
| SPAM1-DAFL | 469 | 123 | 434 | 167 |
| SPAM1-IDAF | 468 | 124 | 433 | 168 |
| SPAM1-CIDA | 467 | 40 | 432 | 47 |
| SPAM1-VCID | 466 | 125 | 431 | 169 |
| SPAM1-GVCI | 465 | 126 | 430 | 170 |

4. Variant Hyaluronan-Degrading Enzymes

Hyaluronan-degrading enzymes provide herein also include allelic or species variants or other variants of a hyaluronan-degrading enzyme. For example, hyaluronan degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art).

For example, also included among haluronan-degrading enzymes are allelic variants or other variants of any of SEQ ID NOS:1, 2, 11, 25, 27-32, 63-65 and 101-102, or truncated forms thereof. Allelic variants and other variants include polypeptides having 60%, 70%, 80%, 90%, 91%, 92%, 93%, 94%, 95%. 96%. 97%. 98% or more sequence identity to any of SEQ ID NOS: 1, 2, 11, 25, 27-32, 63-65 and 101-102, or truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

5. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic effects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc-cores attached via the amide nitrogen of Asn residues that fall within-Asn-Xaa-Thr/Ser-sequences (where Xaa is not Pro). Glycosylation at an-Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides. There are seven potential N-linked glycosylation sites at N82, N166, N235, N254, N368, N393, N490 of human PH20 exemplified in SEQ ID NO: 1. Amino acid residues N82, N166 and N254 are occupied by complex type glycans whereas amino acid residues N368 and N393 are occupied by high mannose type glycans. Amino acid residue N235 is occupied by approximately 80% high mannose type glycans and 20% complex type glycans. As noted above, N-linked glycosylation at N490 is not required for hyaluronidase activity.

In some examples, the hyaluronan degrading enzymes for use in the compositions, formulations, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO: 1 are glycosylated. In some examples the hyaluronan degrading enzymes are glycosylated at one or more native glycosylation sites. In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes for use in the compositions, formulations, combinations and/or methods provided herein are partially deglycosylated (or N-partially glycosylated polypeptides). Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. Treatment of a hyaluronan degrading enzyme, such as a soluble hyaluronidase, such as a soluble PH20, with one or all of these glycosidases can result in only partial deglycosylation and, therefore, retention of hyaluronidase activity.

Partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. For example, treatment of PH20 (e.g. a recombinant PH20 designated rHuPH20) with one or all of the above glycosidases (e.g. EndoF1, EndoF2 and/or EndoF3) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that cleaves all N-glycans, results in complete removal of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO: 1) can be glycosylated, treatment with one or more glycosidases can render the extent of glycosylation reduced compared to a hyaluronidase that is not digested with one or more glycosidases.

The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. In one example, 1, 2, 3, 4, 5 or 6 of the N-glycosylation sites corresponding to amino acids N82, N166, N235, N254, N368, and N393 of SEQ ID NO:1 are partially deglycosylated, such that they no longer contain high mannose or complex type glycans, but rather contain at least an N-acetylglucosamine moiety. In some examples, 1, 2 or 3 of the N-glycosylation sites corresponding to amino acids N82, N166 and N254 of SEQ ID NO:93 are deglycosylated, that is, they do not contain a sugar moiety. In other examples, 3, 4, 5, or 6 of the N-glycosylation sites corresponding to amino acids N82, N166, N235, N254, N368, and N393 of SEQ ID NO:1 are glycosylated. Glycosylated amino acid residues minimally contain an N-acetylglucosamine moiety. Typically, the partially deglycosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

6. Modified Hyaluronan Degrading Enzymes

In one example, the provided compositions and combinations contain hyaluronan degrading enzymes, in particular soluble hyaluronidases, that have been modified to increase the half-life of the hyaluronan degrading enzyme, for example, to promote prolonged/sustained treatment effects in a subject. Exemplary modifications include, but are not limited to, attaching, directly or indirectly via a linker, such as covalently or by other stable linkage, a polymer, such as dextran, polyethylene glycol (PEG), albumin, or sialyl moeity or other such polymers, such as natural or sugar polymers. Other modifications include generation of fusion proteins, such as by linkage to human serum albumin (HAS) or immunoglobulin Fc.

For example, hyaluronan-degrading enzymes can be modified by conjugation to one or more polymeric molecules (polymer). Covalent or other stable attachment (conjugation) of polymeric molecules, such as polyethylene glycol (pegylation moiety (PEG)) impart beneficial properties to the resulting hyaluronan degrading enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan degrading enzyme, such as the hyaluronidase, include natural and synthetic homopolymers, such as polyols (i.e. poly-OH), polyamines (i.e. poly-$NH_2$) and polycarboxyl acids (i.e. poly-COOH), and further heteropolymers i.e. polymers containing one or more different coupling groups e.g. a hydroxyl group and amine groups. Examples of suitable polymeric molecules include polymeric molecules selected from among polyalkylene oxides (PAO), such as polyalkylene glycols (PAG), including polyethylene glycols (PEG), methoxy-polyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran and pullulan, have few reactive groups capable of cross-linking. Typically, the polymers are non-toxic polymeric molecules such as (m) polyethylene glycol (mPEG) which can be covalently conjugated to the hyaluronan degrading enzyme, such as the hyaluronidase (e.g. to attachment groups on the protein's surface) using a relatively simple chemistry.

Polyethylene glycol (PEG) has been widely used in biomaterials, biotechnology and medicine primarily because PEG is a biocompatible, nontoxic, nonimmunogenic and water-soluble polymer (Zhao and Harris, ACS Symposium Series 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, *Adv. Drug Del. Rev.* 16:157-82, 1995). Similarly, PEG has been attached to low molecular weight, relatively hydrophobic drugs to enhance solubility, reduce toxicity and alter biodistribution. Typically, PEGylated drugs are injected as solutions.

Suitable polymeric molecules for attachment to the hyaluronan degrading enzymes, including hyaluronidases, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., *Advanced Drug Delivery Review* 2002, 54: 459-476; Harris and Zalipsky, S (eds.) "Poly(ethylene glycol), Chemistry and Biological Applications" ACS Symposium Series 680, 1997; Mehvar et al., *J. Pharm. Pharmaceut. Sci.,* 3(1):125-136, 2000; Harris, *Nature Reviews Drug Discovery* 2:214 et seq. (2003); and Tsubery, *J Biol. Chem* 279(37):38118-24, 2004).

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. Nos. 5,672,662 ; 5,932,462 ; 6,495,659 ; 6,737,505 ; 4,002,531 ; 4,179,337 ; 5,122,614 ; 5,324,844 ; 5,446,090 ; 5,612,460 ; 5,643,575 ; 5,766,581 ; 5,795,569 ; 5,808,096 ; 5,900,461 ; 5,919,455 ; 5,985,263 ; 5,990,237 ; 6,113,906 ; 6,214,966 ; 6,258,351 ; 6,340,742 ; 6,413,507 ; 6,420,339 ; 6,437,025 ; 6,448,369 ; 6,461,802 ; 6,828,401 ; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; U.S. 2005/0114037; U.S. 2005/0171328; U.S. 2005/0209416; EP 1064951; EP 0822199; WO 01076640; WO 0002017; WO 0249673; WO 9428024; WO 0187925; and WO 05000360).

The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa. In one example, the polyethylene glycol has a molecular weight ranging from about 3 kD to about 50 kD, and preferably from about 5 kD to about 30 kD. Covalent attachment of the PEG to the drug (known as "PEGylation") may be accomplished by known chemical synthesis techniques. For example, the PEGylation of protein may be accomplished by reacting NHS-activated PEG with the protein under suitable reaction conditions.

Various methods of modifying polypeptides by covalently attaching (conjugating) a PEG or PEG derivative (i.e. "PEGylation") are known in the art (see e.g., U.S. 2006/0104968; U.S. Pat. No. 5,672,662; U.S. Pat. No. 6,737,505; and U.S. 2004/0235734). Techniques for PEGylation include, but are not limited to, specialized linkers and coupling chemistries (see e.g., Roberts et al., *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.,* 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Modified hyaluronan degrading enzymes, in particular soluble human recombinant hyaluronidases (e.g. rHuPH20), can be prepared using various PEG reagents. Exemplary PEG reagents include, for example, using mPEG-SBA (30 kD), mPEG-SMB (30 kD), and branched versions based on mPEG2-NHS (40 kD), mPEG2-NHS (60 kD). PEGylated versions of a hyarluonan-degrading enzyme, such as a PH20, for example rHuPH20, can be made using NHS chemistries, as well as carbonates, and aldehydes, using each of the following reagents: mPEG2-NHS-40K branched, mPEG-NHS-10K branched, mPEG-NHS-20K branched, mPEG-NHS-40K branched, mPEG2-NHS-60K branched; mPEG-SBA-5K; mPEG-SBA-20K; mPEG-SBA -30K; mPEG-SMB-20K; mPEG-SMB-30K; mPEG-butyrldehyde-; mPEG-SPA-20K; mPEG-SPA-30K; and PEG-NHS-5K-biotin. PEGylated hyaluronan degrading enzymes also can be prepared using PEG reagents available from Dowpharma, a division of Dow Chemical Corporation; including hyaluronidases PEGylated with Dowpharma's p-nitrophenyl-carbonate PEG (30 kDa) and with propionaldehyde PEG (30 kDa).

While numerous reactions have been described for PEGylation, those that are most generally applicable confer directionality, utilize mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatised PEG more susceptible to nucleophilic attack. The attacking nucleophile is usually the epsilon-amino group of a lysyl residue, but other amines also can react (e.g. the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan degrading enzyme and reduced in the presence of NaCNBH$_3$. More specifically, PEGylated CMP sugars can be reacted with a hyaluronan degrading enzyme in the presence of appropriate glycosyltransferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e. pharmaceuticals) the typical potential immune response is an IgG and/or IgM response, while polypeptides which are inhaled through the respiratory system (i.e. industrial polypeptide) potentially may cause an IgE response (i.e. allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Succinimidyl PEGs containing either linear or branched PEGs can be conjugated to a hyarluronan degrading enzyme. For example, a hyaluronan degrading enzyme, such as a PH20, for example, rHuPH20 can be conjugated with succinimidyl monoPEG (mPEG) reagents including mPEG-Succinimidyl Propionates (mPEG-SPA), mPEG-Succinimidyl Butanoates (mPEG-SBA), and (for attaching "branched" PEGs) mPEG2-N-Hydroxylsuccinimide. These pegylated succinimidyl esters contain different length carbon backbones between the PEG group and the activated cross-linker, and either a single or branched PEG group. These differences can be used, for example, to provide for different reaction kinetics and to potentially restrict sites available for PEG attachment to the enzyme during the conjugation process.

In one example, the PEGylation includes conjugation of mPEG-SBA, for example, mPEG-SBA-30K (having a molecular weight of about 30 KDa) or another succinimidyl esters of PEG butanoic acid derivative, to a soluble hyaluronidase. Succinimidyl esters of PEG butanoic acid derivatives, such as mPEG-SBA-30K readily couple to amino groups of proteins. For example, covalent conjugation of mPEG-SBA-30K and rHuPH20 (which is approximately 60 KDa in size) provides stable amide bonds between rHuPH20 and mPEG, as shown in Scheme 1, below.

Scheme 1:

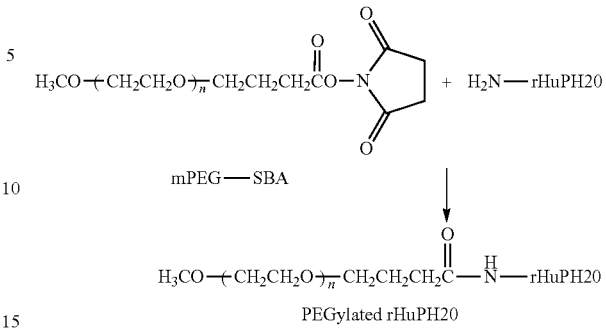

Typically, the mPEG-SBA-30K or other PEG is added to the hyaluronan degrading enzyme, in some instances a hyaluronidase, at a PEG:polypeptide molar ratio of 10:1 in a suitable buffer, e.g. 130 mM NaCl/10 mM HEPES at pH 6.8, followed by sterilization, e.g. sterile filtration, and continued conjugation, for example, with stirring, overnight at 4° C. in a cold room. In one example, the conjugated PEG-hyaluronan degrading enzyme is concentrated and buffer-exchanged.

Other methods of coupling succinimidyl esters of PEG butanoic acid derivatives, such as mPEG-SBA-30K are known in the art (see e.g., U.S. Pat. No. 5,672,662; U.S. Pat. No. 6,737,505; and U.S. 2004/0235734). For example, a polypeptide, such as a hyaluronan degrading enzyme (e.g. a hyaluronidase), can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration. Another method reacts polypeptide with mPEG-SBA in deionized water to which triethylamine is added to raise the pH to 7.2-9. The resulting mixture is stirred at room temperature for several hours to complete the PEGylation.

PEGs can used to generate hyaluronan-degrading enzymes, such as a PH20, for example rHuPH20, that have between or about three to six PEG molecules per enzyme. Such pegylated rHuPH20 compositions can be readily purified to yield compositions having specific activities of approximately 25,000 or 30,000 Unit/mg protein hyaluronidase activity, and being substantially free of non-PEGylated enzyme (less than 5% non-PEGylated).

7. Methods of Producing Nucleic Acids and Encoded Polypeptides of Hyaluronan Degrading Enzymes Polypeptides of a hyaluronan degrading enzyme, such as a soluble hyaluronidase, set forth herein, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a hyaluronidase, such as from a cell or tissue source. Modified or variant soluble hyaluronidases, can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

a. Vectors and Cells

For recombinant expression of one or more of the desired proteins, such as any described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the hyaluronan degrading enzyme polypeptide, in some examples a soluble hyaluronidase polypeptide, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrera-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain 2 gene control region which is active in skeletal muscle (Shani, *Nature* 314: 283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and, optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

b. Expression

Hyaluronan degrading enzyme polypeptides, including soluble hyaluronidase polypeptides, can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Hyaluronan degrading enzyme polypeptides, such as soluble hyaluronidase polypeptides, also can be utilized or expressed as protein fusions. For example, an enzyme fusion can be generated to add additional functionality to an enzyme.

Examples of enzyme fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

i. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

ii. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces* cerevisae and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

iii. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

iv. Mammalian Cells

Mammalian expression systems can be used to express proteins including hyaluronan degrading enzyme polypeptides, such as soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO-S cells (Invitrogen, Carlsbad, Calif., cat #11619-012) and the serum free EBNA-1 cell line (Pham et al., (2003) *Biotechnol. Bioeng.* 84:332-42.). Cell lines also are available that are adapted to grow in special media optimized for maximal expression. For example, DG44 CHO cells are adapted to grow in suspension culture in a chemically defined, animal product-free medium.

v. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

c. Purification Techniques

Method for purification of polypeptides, including hyaluronan degrading enzyme polypeptides (e.g. soluble hyaluronidase polypeptides) or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as soluble hyaluronidase polypeptides, can be purified using standard protein purification techniques known in the art including but not limited to, SDS-PAGE, size fraction and size exclusion chromatography, ammonium sulfate precipitation and ionic exchange chromatography, such as anion exchange chromatography. Affinity purification techniques also can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or His$_6$ and affinity purified with myc antibody, glutathione resin and Ni-resin, respectively. Purity can be assessed by any method known in the art including gel electrophoresis and staining and spectrophotometric techniques. Purified rHuPH20 compositions, as provided herein, typically have a specific activity of at least 70,000 to 100,000 Units/mg, for example, about 120,000 Units/mg. The specific activity can vary upon modification, such as with a polymer.

D. Compositions And Sustained Release Formulations Of Hyaluronan-Degrading Enzymes Provided herein are compositions and sustained or controlled release formulations containing a hyaluronan-degrading enzyme composition. Also provided herein are compositions and sustained or controlled release formulations containing a hyaluronan-degrading enzyme and another BPH-therapeutic agent, such as a 5-alpha reductase inhibitor. The hyaluronan-degrading enzyme in the compositions and sustained release formulations are stable and retain activity of the hyaluronidase that is not so formulated. Sustained release formulations include any that permit sustained release, prevent access to the general circulation and increase the prostate specific localization of the compositions. Non-limiting examples of sustained release formulations include, for example, depot formulations and lipid membrane vesicles containing a hyaluronan-degrading enzyme.

1. Hyaluronan Degrading Enzyme Compositions

Pharmaceutically acceptable compositions are prepared in view of approvals for a regulatory agency or other agency prepared in accordance with generally recognized pharmacopeia for use in animals and in humans. The compounds can be formulated into any suitable pharmaceutical preparations for any of oral, subcutaneous, intravenous and intraprostatic administration such as solutions, suspensions, powders, or sustained release formulations. Typically, the compounds are formulated into pharmaceutical compositions using techniques and procedures well known in the art (see e.g., Ansel *Introduction to Pharmaceutical Dosage Forms*, Fourth Edition, 1985, 126. The formulation should suit the mode of administration.

Direct introduction of the enzyme into the prostate generally characterized by injection or infusion, is contemplated herein. Injectables can be prepared in conventional forms, either as liquid solutions or suspensions, solid forms suitable for solution or suspension in liquid prior to injection, or as emulsions. Preparations for intraprostatic administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use, sterile emulsions, sterile gels and sterile solutions that form gels in the body. The solutions may be either aqueous or nonaqueous. Hence, the compositions can be formulated in lyophilized or liquid form. Where the compositions are provided in lyophilized form they can be reconstituted just prior to use by an appropriate buffer, for example, a sterile saline solution.

In one example, pharmaceutical preparation can be in liquid form, for example, solutions, syrups or suspensions. If provided in liquid form, the pharmaceutical preparations can be provided as a concentrated preparation to be diluted to a therapeutically effective concentration before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid).

In another example, pharmaceutical preparations can be presented in lyophilized form for reconstitution with water or other suitable vehicle before use. For example, lyophilized powders can be reconstituted for administration as solutions, emulsions and other mixtures. They can also be reconstituted and formulated as solids or gels. The sterile, lyophilized powder is prepared by dissolving an active compound in a buffer solution. The buffer solution can contain an excipient which improves the stability or other pharmacological component of the powder or reconstituted solution, prepared from the powder. Subsequent sterile filtration of the solution followed by lyophilization under standard conditions known to those of skill in the art provides the desired formulation. Briefly, the lyophilized powder is prepared by dissolving an excipient, such as dextrose, sorbitol, fructose, corn syrup, xylitol, glycerin, glucose, sucrose or other suitable agent, in a suitable buffer, such as citrate, sodium or potassium phosphate or other such buffer known to those of skill in the art. Then, a selected compound is added to the resulting mixture, and stirred until it dissolves. The resulting mixture is sterile filtered or treated to remove particulates and to insure sterility, and apportioned into vials for lyophilization. Each vial will contain a single dosage or multiple dosages of the compound. The lyophilized powder can be stored under appropriate conditions, such as at about 4° C. to room temperature. Reconstitution of this lyophilized powder with a buffer solution provides a formulation for use in administration.

Pharmaceutical compositions can include carriers such as a diluent, adjuvant, excipient, or vehicle with which the hyaluronidase is administered. Examples of suitable pharmaceutical carriers are described in "Remington's Pharmaceutical Sciences" by E. W. Martin. Such compositions will contain a therapeutically effective amount of the compound or agent, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. For example, suitable excipients are, for example, water, saline, dextrose, glycerol or ethanol. A composition, if desired, also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

The compositions of a hyaluronan-degrading enzyme are generally stable for days, weeks or years over a wide range of temperatures. For example, hyaluronan-degrading enzyme compositions are stable at temperatures of between 4° C. to 37° C., and in particular at temperatures of at least or 5° C., 25° C., 30° C. or 37° C. The hyaluronan-degrading enzymes are stable for at least 1 month, 6 months, 1 year 2 years or more. Generally, the compositions are stable for at least 2 years at 2° C. to 8° C.

Included among the types of stabilizers that can be included in the hyaluronan-degrading enzyme compositions are amino acids, amino acid derivatives, amines, polyols, and other agents. Exemplary stabilizers include, but are not limited to, poloxamer 188 (e.g. Pluronic® F68), polysorbate 80 (PS80), polysorbate 20 (PS20), L-arginine, glutamine, lysine, methionine, proline, Lys-Lys, Gly-Gly, trimethylamine oxide, betaine, glycerol, sorbitol, mannitol, inositol, sucrose, trehalose, magnesium chloride, zinc, serum albumin (such as human serum albumin), phenyl butyric acid, taurocholate, polyvinylpyrolidone (PVP), dextran, and polyethylene glycol (PEG).

In some examples, hyaluronic acid (HA) oligomers are included in the formulations provided herein to stabilize the hyaluronan degrading enzymes. Hyaluronic acid (HA, also known as hyaluronan and hyaluronate) is the natural substrate for hyaluronan degrading enzymes such as soluble hyaluronidases, including rHuPH20. HA is a non-sulfated glycosaminoglycan that is widely distributed throughout connective, epithelial, and neural tissues. It is a polymer of up to 25,000 disaccharide units, themselves composed of D-glucuronic acid and D-N-acetylglucosamine. The molecular weight of HA ranges from about 5 kDa to 20,000 kDa. By catalyzing the hydrolysis of hyaluronan, hyaluronan degrading enzymes, for example soluble hyaluronidases such as rHuPH20, lowers the viscosity of hyaluronan, thereby increasing tissue permeability and increasing the absorption rate of fluids administered parenterally.

As demonstrated herein, hyaluronic acid (HA) is an efficient stabilizer of hyaluronan degrading enzymes, for example soluble hyaluronidases such as rHuPH20. In particular, hyaluronan is an efficient stabilizer in the presence of otherwise destabilizing agents and conditions, such as, for example, low salt, high pH, and elevated temperatures. Thus, provided herein are compositions containing HA and a hyaluronan degrading enzyme. Any size HA can be used in the compositions as a stabilizer. In some examples, the molecular weight of the HA is from or from about 5 kDa to or to about 5,000 kDa; from or from about 5 kDa to or to about 1,000 kDa; from or from about 5 kDa to or to about 500 kDa; or from or from about 5 kDa to or to about 200 kDa. For example, included among the compositions provided herein of HA and a hyaluronan degrading enzyme, such as a soluble hyaluronidase (e.g. rHuPH20), are those that contain HA having a molecular weight of at least or about at least 5 kDa, 6 kDa, 7 kDa, 8 kDa, 9 kDa, 10 kDa, 15 kDa, 20 kDa, 30 kDa, 40 kDa, 50 kDa, 60 kDa, 70 kDa, 80 kDa, 90 kDa, 100 kDa, 120 kDa, 140 kDa, 160 kDa, 180 kDa, 200 kDa, 220 kDa, 240 kDa, 260 kDa, 280 kDa, 300 kDa, 3500 kDa, 400 kDa, 450 kDa, or 500 kDa.

The HA oligomers are included in compositions of a hyaluronan-degrading enzyme of at or between 1 mg/mL to 100 mg/mL, such as 1 mg/mL to 20 mg/mL, and in particular at least or about at least 1 mg/mL, 2 mg/mL, 3 mg/mL, 4 mg/mL, 5 mg/mL, 6 mg/mL, 7 mg/mL, 8 mg/mL, 9 mg/mL, 10 mg/mL, 11 mg/mL, 12 mg/mL, 13 mg/mL, 14 mg/mL, 15 mg/mL, 16 mg/mL, 17 mg/mL, 18 mg/mL, 19 mg/mL or 20 mg/mL or more HA. Exemplary stable formulations of a hyaluronan-degrading enzyme, for example a soluble hyaluronidase such as rHuPH20 include from or from about 8 mg/mL to or to about 15 mg/mL HA, such as, for example 10 mg/mL or about 10 mg/mL or 15 mg/mL or about 15 mg/mL. In some examples, the molar ratio of HA to hyaluronan degrading enzyme is or is about 5000:1, 4000:1, 3000:1, 2000:1, 1900:1, 1800:1, 1700:1, 1650:1, 1600:1, 1500:1, 1400:1, 1300:1, 1200:1, 1100:1, 1000:1, 900:1, 800:1, 700:1, 600:1, 500:1, 100:1, 90:1, 80:1, 70:1, 60:1, 50:1, 40:1, 30:1, 20:1, 10:1, 1:1, 1:10, 1:20, 1:30, 1:40, 1:50, 1:60, 1:70, 1:80, 1:90, 1:100, 1:500, 1:600, 1:700, 1:800, 1:900, 1:1000, 1:1100, 1:1200, 1:1300, 1:1400, 1:1500, 1:1600, 1:1700, 1:1800, 1:1900, 1:2000, 1:3000, 1:4000, 1:5000 or less.

In some examples, a standard stabilized formulation of a hyaluronan-degrading enzyme as provided herein is formulated with one or more of EDTA, NaCl, CaCl$_2$, histidine, lactose, albumin, Pluronic® F68, TWEEN® and/or other detergent or other similar agents. For example, compositions provided herein can contain one or more pH buffers (such as, for example, histidine, phosphate, or other buffers), or acidic buffer (such as acetate, citrate, pyruvate, Gly-HCl, succinate, lactate, maleate or other buffers), tonicity modifier (such as, for example, an amino acid, polyalcohol, NaCl, trehalose, other salts and/or sugars), stabilizer, chelating agent, such as ethylenediaminetetraacetic acid, ethylenediaminetetraacetate or calcium EDTA, oxygen scavenger, such as methionine, ascorbic acid/ascorbate, citric acid/citrate, or albumin, and/or a preservative, such as preservative containing an aromatic ring (e.g. phenol or cresol).

For example, buffers that can be included in the co-formulations provided herein include, but are not limited to, Tris (Tromethamine), histidine, phosphate buffers, such as dibasic sodium phosphate, and citrate buffers. Such buffering agents can be present in the concentrations between or about 1 mM to 100 mM, for example, at least or about at least or about or 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 16 mM, 17 mM, 18 mM, 19 mM, 20 mM, 25 mM, 30 mM, 35 mM, 40 mM, 45 mM, 50 mM, 55 mM, 60 mM, 65 mM, 70 mM, 75 mM, or more.

Exemplary stabilizers that are useful for compositions containing a hyaluronan degrading enzyme include detergents, such as polysorbates and proteins such as human serum albumin. Exemplary concentrations of serum albumin that are useful in the compositions herein include at or between 0.1 mg/mL to 1 mg/mL, for example at least or 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL or 1 mg/mL, but can be more or less. Polysorbates also can be present in the compositions at, for example, concentrations of or about 0.001% to 0.1%, for example at least or 0.001%, 0.002%, 0.003%, 0.004%, 0.005%, 0.006%, 00.007%, 0.008%, 0.009%, 0.01%, 0.02%, 0.03%, 0.04%, 0.05%, 0.06%, 0.07%, 0.08%, 0.09% or 0.1%. A metal chelating agent, such as calcium EDTA (CaEDTA), also can be present, such as for example, at concentrations of between approximately 0.02 mM to 20 mM, such as at least or 0.02 mM, 0.04 mM, 0.06 mM, 0.08 mM, 0.1 mM, 0.2 mM, 0.3 mM, 0.4 mM, 0.5 mM, 0.6 mM, 0.7 mM, 0.8 mM, 0.9 mM, 1 mM, 5 mM, 10 mM, 15 mM, 20 mM or more. The pH and the osmolarity of the compositions can be adjusted by one of skill in the art to optimize the conditions for the desired activity and stability of the composition. In some examples, the compositions provided herein have an osmolarity of at or between about 100 mOsm/kg to 500 mOsm/kg, for example at least or about 100 mOsm/kg, 120 mOsm/kg, 140 mOsm/kg, 160 mOsm/kg, 180 mOsm/kg, 200 mOsm/kg, 220 mOsm/kg, 240 mOsm/kg, 260 mOsm/kg, 280 mOsm/kg, 300 mOsm/kg, 320 mOsm/kg, 340 mOsm/kg, 360 mOsm/kg, 380 mOsm/kg, 400 mOsm/kg, 420 mOsm/kg, 440 mOsm/kg, 460 mOsm/kg, 500 or more mOsm/kg, and a pH of at or about 6, 6.2, 6.4, 6.6, 6.8, 7, 7.2, 7.4, 7.6, 7.8 or 8.

Generally NaCl is provided in formulations herein, for example, in an amount that is or is about 100 mM-150 mM or more. For example, an exemplary formulation can contain at or about 10 mM histidine and/or at or about 130 mM NaCl. Other formulations can contain in addition or alternatively lactose, for example, at or about 13 mg/ml. Additionally, an anti-bacterial or anti-fungal agent, including, but not limited to thiomersal, can be present in the formulation. Formulations can further contain Albumin, Pluronic® F68, TWEEN® and/or other detergent. The formulations are provided at a pH that is or is about between 6.0 to 7.4, for example at least or 6.0, 6.1., 6.2, 6.3, 6.4, 6.5, 6.6, 6.7, 6.8, 6.9, 7.0, 7.1, 7.2, 7.3 or 7.4, generally that is or is about pH 6.5. Concentrated formulations of a hyaluronan-degrading enzyme, for example a soluble hyaluronidase such as rHuPH20 for use herein are generally diluted in a saline solution or other salt buffered solution prior administration to maintain the appropriate salt concentration.

Pharmaceutical compositions of soluble hyaluronidases, for example, the recombinant PH20 designated rHuPH20, are known in the art (see e.g. published U.S. Application Nos. 20040268425, 20050260186 and 20060104968).

2. Sustained Release Formulations

The hyaluronan-degrading enzyme compositions are provided in sustained or controlled release formulations. In some examples, the sustained or controlled release formulations also contain a second therapeutic agent, for example, a BPH therapeutic agent. The formulations can be formulated for local injection. For example, the formulations are formulated for intraprostatic injections, such as via transrectal, transurethral or transperineal injection into the prostate.

Exemplary sustained release formulations include, but are not limited to, lipid vesicles including unilamellar vesicles (LUV) and multilamellar vesicles (MLV), drug-resin complexes (resinates), and depot formulations. Such sustained or controlled release formulations are known to one of skill in the art. For example, a hyaluronan-degrading enzyme can be encapsulated in a colloidal dispersion system or in polymer stabilized crystals. Useful colloidal dispersion systems include nanocapsules, microspheres, beads, and lipid based systems, including oil-in-water emulsions, micelles, mixed micelles, and liposomes. Some examples of lipid-polymer conjugates and liposomes are disclosed in U.S. Pat. No. 5,631,018, which is incorporated herein by reference in its entirety. Examples of processes to make multilamellar and unilamellar liposomes are known in the art (see e.g. U.S. Pat. Nos. 4,522,803, 4,310,506, 4,235,871, 4,224,179, 4,078,052, 4,394,372, 4,308,166, 4,485,054 and 4,508,703). Other examples of slow release delivery vehicles are biodegradable hydrogel matrices (U.S. Pat. No. 5,041,292), dendritic polymer conjugates (U.S. Pat. No. 5,714,166), and multivesicular liposomes (DepoFoam®, DepoTech, San Diego, Calif.) (U.S. Pat. Nos. 5,723,147 and 5,766,627). One type of microspheres suitable for encapsulating the compositions for local injection, for example into the prostate, is poly(D,L-lactide) microspheres, as described in Fletcher, D. Anesth. Analg. 84:90-94 (1997).

In particular, the sustained release formulations provided herein can be designed such that the enzyme (or other agent(s)) is released at a predetermined rate or such that a constant level of drug is maintained for a specific period of time. In particular, the formulations permit a controlled release of the hyaluronan-degrading enzyme (or other agent(s)) to the local tissue, such as prostatic tissue. The rate of release is sufficiently slow such that the resulting effect of the enzyme on HA degradation in the tissue (e.g. stroma) is extended over many hours, days, weeks or months. For example, release of the hyaluronidase and other therapeutic agents once introduced into the prostate can be from approximately 24 hours, 36 hours or 48 hours to approximately 90 days. For example, sustained release formulations are provided that permit dosage of the formulation at least once a week, once a month, once every two months, once every three months, once every four months, once every five months, once every six months, once every seven months, once every eight months, once every nine months, once every ten months, once every eleven months, or once a year by local tissue injection, such as by intraprostatic injection. The optimum release rate and duration for the sustained release formulations of a hyaluronan-degrading enzyme can be determined by those of skill in the art based on the pharmacological properties of the specific agents, the severity of the condition, the age and health of the subject, and other factors.

It is within the level of one of skill in the art to empirically determine whether the rate of release of the enzyme or the level of the drug is sufficient to result in an effect on the local tissue, such as the prostate tissue. For example, prostate size (e.g. shrinkage) can be examined. In other examples, degradation of HA in the local tissue (e.g. stroma) can be monitored over time by histology or other method from a tissue sample, for example a prostate sample, such as from a biopsy sample. In a further example, the activity of hyaluronan degrading enzyme released into the blood or serum can be measured. Any assay known to one of skill in the art to measure the hyaluronidase in the plasma can be performed. For example, a microturbidity assay or enzymatic assay can be performed on protein in plasma. It is understood that plasma normally contains hyaluronidase enzymes. Such plasma hyaluronidase enzymes typically have activity at an acidic pH (U.S. Pat. No. 7,105,330). Hence, before treatment with a sustained release formulation as described herein, the plasma levels of hyaluronidase should be determined and used as a baseline. Subsequent measurements of plasma hyaluronidase levels after treatment can be compared to the levels before treatments. Alternatively, the assay can be performed under pH conditions that suppress endogenous lysosomal hyaluronidase activity in plasma, which normally exhibits activity at acidic pH. Thus, where the hyaluronan-degrading enzyme is active at neutral pH (e.g. human PH20), only the level of the neutral-active enzyme is measured.

Further, the sustained release formulations provided herein can be designed such that the hyaluronan-degrading enzyme is relatively stable and active. For example, the sustained release formulations are provided such that the total hyaluronan degrading enzyme activity of the formulation is at or between 25,000 U/mg to 200,000 U/mg, for example 40,000 U/mg to 150,000 U/mg such as 75,000 U/mg to 120,000 U/mg and in particular at least or 40,000 U/mg, 50,000 U/mg, 60,000 U/mg, 70,000 U/mg, 80,000 U/mg, 90,000 U/mg, 100,000 U/mg, 110,000 U/mg, 120,000 U/mg, 130,000 U/mg, 140,000 U/mg, 150,000 U/mg or more. In particular, the sustained release formulations are designed such that stability is effected at temperatures from or between 2° C. to 37° C., for example, 4° C. to 25° C. and in particular from or between 2° C. to 8° C. or from or between 20° C. to 30° C., such as or about 25° C. In particular examples, the sustained release formulations are stable under storage conditions for at least 1 week, one month, two months, three months, four months, five months, six months, seven months, eight months, nine months, ten months, eleven months, 1 year, 2 years or more.

In examples herein, sustained release formulations are provided that contain a hyaluronan-degrading enzyme and another therapeutic agent for treating a desired disease or conditions. For example, if the disease or condition is BPH, sustained release formulations can be prepared that, in addition to a hyaluronan-degrading enzyme, also contain another agent suitable for treatment of BPH. The combined sustained release formulations provide long-lasting prolonged activity of at least two agents for treating the disease or condition. Combination therapy for treating BPH is further described in Section F herein. Hence, any of the therapeutic agents set forth in Section F can be co-formulated with a hyaluronan-degrading enzyme in the sustained release formulations herein.

Non-limiting examples of sustained release formulations and exemplary formulations are provided below.

a. Depot Gel Formulation

The hyaluronan-degrading enzyme compositions can be administered as a depot gel formulation that permits sustained release, prevents access to the general circulation and increases the prostate specific localization of the compositions. Those in the art are familiar with materials and methods that can be utilized to formulate single drugs and combinations as injectable liquids, gels or pastes that can be deposited in the body with predetermined release rates and durations.

The compositions can be provided in a gel or form a gel following administration, which is typically by injection. Gels can be delivered as liquid compositions containing a material that forms a gel following introduction into the body. A solution containing the gel-forming material and hyaluronan-degrading enzyme can be prepared by combining the gel-forming material and the enzyme in solution using any suitable method, e.g., by adding the enzyme to a solution containing the gel-forming material. The solution forms a gel following introduction into the body, e.g., upon contact with a physiological fluid.

Release of the agents from the gel can occur by any mechanism, e.g., by diffusion of the agents out of the gel, as a result of breakdown of the gel, or both. The gel-forming material can also contain some other materials, such as a solid, which can modulate the release of the enzyme or other therapeutic agents.

A variety of different gel-forming materials can be used. Generally, the gel is a hydrogel, a gel that contains a substantial amount of water, it is biocompatible and the gel is biodegradable. Gel-forming materials include, but are not limited to, polysaccharides such as alginate and modified forms thereof, other polymeric hydrogel precursors include polyethylene oxide-polypropylene glycol block polymers such as Pluronics® or Tetronics® (BASF, Florham Park, N.J.) which are cross linked by hydrogen bonding and/or by temperature change, polymer mixtures, e.g., a mixture of polyethylene oxide and polyacrylic acid which gels by hydrogen bonding upon mixing and other soluble gel-forming materials (U.S. Pat. No. 6,129,761). Other suitable hydrogels are described in Peppas, N. A., et al. (2000) Eur J Pharm Biopharm. 50(1):27-46; Megeed, Z., et al. (2002) Pharm Res. 19(7):954-9 and U.S. Pat. No. 6,129,761. A suitable additive for forming an injectable gel is a medical-grade gelling agent. One such gelling agent is Gelfoam® sterile powder (Pfizer, N.Y.). Gelfoam® is a gelatin powder containing particles in the 40-60 micron size range.

Depot gel formulations for use in the hyaluronan-degrading formulations provided herein also can include phospholipid gel compositions containing 20 to 80%, such as 25 to 70% by weight, for example 30 to 60% by weight of one or more phospholipids and 0.1 to 70% by eight water such that the gel composition can be extruded through a needle for injections. The phospholipid depots are one-phase gels that can be aqueous or substantially anhydrous. Thus, in some examples, instead of water the one-phase phospholipid gel compositions can be prepared with 5 to 60%, such as 10 to 50%, for example 20 to 40% by weight of a non-aqueous component. The non-aqueous component can be a sugar, oil or a solvent. For example, the oil can be sesame oil, medium chain oil, ethyl oleate or synthetic triglyceride. Such one-phase phospholipid depot gel compositions are described in detail in International Published PCT Application No. WO2011/075623. Such depot gel formulations are particularly useful to dissolve water-insoluble or hydrophobic agents, such as finasteride and other BPH therapeutic agents. One-phase gel compositions can be used to prepare depot formulations containing a hyaluronan-degrading enzyme and another therapeutic drug that is a hydrophobic drug, such as finasteride.

b. Multivesicular Liposomes (MVL)

Provided herein are synthetic membrane vesicles, such as multivesicular liposomes (MVL) formulations, having encapsulated therein a hyaluronan-degrading enzyme, and in particular a hyaluronidase such as PH20 or soluble or recombinant PH20. In some examples described herein, MVL-coformulations are provided additionally containing encapsulation of another therapeutic drug. Multivesicular liposome formulations contain microscopic, spherical particles composed of numerous non-concentric aqueous chambers encapsulating a drug or agent to be delivered. The individual chambers are separated by lipid bilayer membranes composed of synthetic duplicates or naturally occurring lipids, resulting in a delivery vehicle that is both biocompatible and biodegradable. In examples herein, hyaluronan-degrading enzymes or other therapeutic agents that are hydrophilic can be encapsulated in the aqueous phase. In other examples herein, an MVL co-formulation is provided by co-encapsulation of a hydrophilic drug and a hydrophobic drug in the same formulation. For example, in such MVL co-formulations, the hyaluronan-degrading enzyme is encapsulated in the aqueous phase and a hydrophobic drug, for example finasteride or dutasteride, are intercalated into the lipid phase.

The membrane vesicles can be used in methods for delivering a hyaluronan-degrading enzyme, and if desired also another agent, to a subject to be used as an adjuvant, spreading agent or therapeutic. In particular, the membrane vesicles are provided in pharmaceutical compositions for use as a therapeutic agent. For example, hyaluronan-degrading enzymes, and in particular membrane vesicles containing hyaluronan-degrading enzymes, can be used in methods, uses and processes for treating benign prostatic hyperplasia (BPH). Exemplary of membrane vesicles are those that achieve controlled or sustained release of the hyaluronan-degrading enzyme.

Multivesicular liposomes (MVL) provided herein are made based on processes known to one of skill in the art (see e.g. U.S. Pat. Nos. 5,723,147; 5,766,627; 6,106,858; 6,306,432; 5,962,016; 6,241,999; published U.S. Patent Appl. No. US2007/0235889 and US2010/030550; and published International Appl. No. WO02/096368). In generating such liposomes, any of the hyaluronan-degrading enzyme compositions described above in Section C, or known to one of skill in the art, can be encapsulated within the multivesicular liposomes. Briefly, a "water-in-oil" emulsion containing a hyaluronan-degrading enzyme to be encapsulated is first made by dissolving amphipathic lipids and neutral lipids in a volatile organic solvent for the lipid component, adding to the lipid component an immiscible first aqueous component containing the enzyme and/or other agent to be encapsulated and one or more helper molecules, i.e. osmotic excipients, that provide useful and beneficial properties to the MVLs. The mixture is emulsified by mixture, for example, mechanically as by mixing, shaking, sonication, by ultrasonic energy, nozzle atomization, or combinations thereof. The hyaluronan-degrading enzyme to be encapsulated can be contained in the first aqueous component or the lipid component or both. The whole water-in-oil emulsion is then mixed with the second aqueous component and then agitated mechanically, as above, to form solvent spherules suspended in the second aqueous component. The solvent spherules contain multiple aqueous droplets with the substance to be encapsulated dissolved therein. The volatile organic solvent is removed, for instance by evaporation, from the spherules. When the solvent is completely evaporated, multivesicular liposomes are formed. The MVLs are resuspended, washed and stored in a third aqueous solution such as saline or suitable buffer that allows particle stability at storage temperatures. Representative gases satisfactory for use in evaporating the solvent include nitrogen, helium, argon, oxygen, hydrogen and carbon dioxide. Alternatively, the organic solvent can be removed by sparging, rotary evaporation or solvent selective membranes.

Generally, successful encapsulation can only be achieved for hydrophilic molecules. As described further below, it is found herein that hydrophobic molecules can be incorporated into the lipid bilayer by dissolving the lipids and the hydrophobic drug into an organic solvent prior to mixing with a first aqueous component containing the hydrophilic drug (e.g. a hyaluronan-degrading enzyme). Hence, the methods herein can be used to also generate MVL co-formulations by co-encapsulation of a hydrophobic and hydrophilic drug in the same formulation.

Many different types of volatile hydrophobic solvents, such as ethers, halogenated ethers, hydrocarbons, esters, halogenated hydrocarbons, or Freons can be used as the lipid-phase solvent. For example, diethyl ether, isopropyl and other ethers, chloroform, methylene chloride, tetrahydrofuran, ethyl acetate, Forane and combinations thereof can be used in making multivesicular liposomes.

Various types of lipids can be used to make multivesicular liposomes, so long as the lipid component contain one neutral lipid and one amphipathic lipid. Examples of neutral lipids include diglycerides, such as diolefin, dipalmitolein; propylene glycol esters such as mixed diesters of caprylic/capric acids on propylene glycol; triglycerides such as triolein, tripalmitolein, trilinolein, tricaprylin and trilaurin; vegetable oils, such as soybean oil; lard or beef fat; squalene; tocopherol; and combinations thereof. In particular examples, slow release neutral lipids include, for example, triolein, tripalmitolein, trimyristolein, trilaurin, and tricaprin. Fast release neutral lipids include, for example, tricaprylin and tricaproin and mixtures thereof. Examples of amphipathic lipids include those with net negative charge, zero net charge, and net positive charge at pH 7.4. These include zwitterionic, acidic or cationic lipids. Such exemplary amphipathic lipids include, but are not limited to, phosphatidylglycerol (PG), cardiolipin (CL), phosphatidylserine (PS), phosphatidic acid (PA), phosphatidylinositol, phosphatidylcholine (PC), phosphatidylethanolamine (PE), sphingomyelin, diacyl trimethylammonium propane (DITAP) and combinations thereof. Additionally, cholesterol or plant sterols can be used to make multivesicular liposomes. The lipid component chosen also can be one that has a melting point below the temperature at which the MVL is to be stored and/or used (see e.g. U.S. Pat. No. 5,962,016).

In the examples of the synthetic membrane vesicles provided herein, the hyaluronan-degrading enzyme, and in particular a hyaluronidase such as PH20 or recombinant PH20, is encapsulated in the presence of one or more excipients that preserve or enhance the stability of the enzyme and/or increase the rate of encapsulation of the enzyme. In particular examples, the excipient is hyaluronic acid (also called hyaluronan; HA). For example, provided herein are multivesicular liposomes (MVLs) for sustained or controlled release that have encapsulated therein a hyaluronan-degrading enzyme, and in particular a hyaluronidase such as PH20 or recombinant PH20 and one or more excipients that preserve or enhance the stability of the enzyme and/or increase the rate of encapsulation of the enzyme.

Exemplary of the mixers that can be used in the provided methods are homogenizers (also called shears), for example, high shear lab homogenizers, which can be used, for example, to emulsify the first aqueous phase and the solvent, e.g., chloroform, or to emulsify the first emulsion with the second aqueous phase. Exemplary of the homogenizers that can be used in the provided methods are high shear homogenizers, for example, Omni mixers sold by Omni International, Kennesaw, Ga., for example, an Omni Macro Homogenizer or an Omni Macro ES Homogenizer, which have 1,800 watt motors, speed control from 1,000 to 20,000 rpm, sample processing volume from 0.25 mL to 30 L, and varying blade assemblies for mixing.

The particle size of the resulting MVL can vary. It is within the level of one of skill in the art to determine the size of a membrane vesicle and to select a vesicle based on a desired application. For example, particle size analysis can be performed, for example using a laser diffraction particle size analyzer. In some examples, membrane vesicles provided herein have an average diameter that is from about or between 0.5 μm to 100 μm, for example at least or about or 0.5 μm, 1 μm, 5 μm, 10 μm, 15 μm, 20 μM, 50 μm or 100 μm.

The resulting MVL formulations or co-formulations can be further diluted or suspended by addition of suspending medium or other biologically acceptable carrier to obtain injectable or implantable slow release depot formulations. Common suitable carriers include aqueous or non-aqueous solutions, suspensions and emulsions. Examples of non-aqueous solutions are propylene glycol, polyethylene glycol, vegetable oils, such as olive oil, and injectable organic esters such as ethyl oleate. Aqueous carriers include water, alcoholic aqueous solutions, emulsions or suspensions, including saline and buffered media. Parenteral vehicles include sodium chloride solutions, Ringer's dextrose, dextrose, and lactated Ringer's solution. Intravenous vehicles include fluid and nutrient replenishers, electrolyte replenishers (such as those based on Ringer's dextrose). Preservatives and other additives can also be present, such as antimicrobials, antioxidants, chelating agents, and inert gases (see, Remingtons Pharmaceutical Sciences, $16^{th}$ Ed., A. Oslo, ed., Mack, Easton, Pa. 1980).

Provided herein are stable compositions of MVL formulations encapsulated with a hyaluronan-degrading enzyme. Also provided are stable compositions of MVL co-formulations encapsulated with a hyaluronan-degrading enzyme and a hydrophobic drug, in particular a drug such as finasteride, dutasteride or other suitable drug. The formulations or co-formulations are stable at 2° C. to 32° C. for at least one month, at least two months, at least three months, at least four months, at least five months, at least six months, at least seven months, at least eight months, at least nine months, at least ten months, at least eleven months, at least a year, at least two years or more. For example, the formulations or co-formulations are stable at 2° C. to 8° C. for at least one year or at least 2 years. In another example, the formulations of co-formulations are stable at 28° C.-32° C. for at least 6 months or at least one year.

i. Parameters to Improve Encapsulation, Stability and Release Rate

In generating MVL formulations as described above, it is found herein that the encapsulation efficiency, stability and release rate of a hyaluronan-degrading enzyme can be modified (e.g. increased or improved) based on particular parameters and conditions. For example, methods can be employed to increase the efficiency of encapsulation of the hyaluronan-degrading enzyme. The efficiency with which an agent (e.g. hyaluronan-degrading enzyme) is encapsulated can be modulated by altering the numbers of carbons in the carbon chain of at least one of the amphipathic lipids used in the preparation of the liposomal formulation. For example, the encapsulation efficiency can be increased by increasing the number of carbons in the carbon chain of at least one of the amphipathic lipids used in the preparation of the liposomal formulation (see e.g., U.S. Pat. No. 6,241,999). A non-limiting list of long chain amphipathic lipids that can be used in the generation of multivesicular liposomes herein include, for example: DOPC or DC18:1 PC=1,2-dioleoyl-sn-glycero -3-phosphocholine; DLPC or DC12:0 PC=1,2-dilauroyl-sn-glycero-3-phosphocholine; DMPC or DC14:0 PC=1,2-dimyristoyl-sn-glycero-3-phosphocholine; DPPC or DC16:0 PC=1,2-dipalmitoyl-sn-glycero-3-phosphocholine; DSPC or DC18:0 PC=1,2-distearoyl-sn-glycero-3-phosphocholine; DAPC or DC20:0 PC=1,2diarachidoyl-sn-glycero -3-phosphocholine; DBPC or DC22:0 PC=1,2-dibehenoyl-sn-glycero-3-phosphocholine; DC14:1 PC=1,2-dimyristoleoyl-sn-glycero-3-phosphocholine; DC16:1 PC=1,2-dipalmitoleoyl-sn-glycero-3-phosphocholine; DC20:1 PC=1,2-dieicosenoyl-sn-glycero-3-phosphocholine; DC22:1 PC=1,2-dierucoyl-sn-glycero-3-phosphocholine; DPPG=1,2-dipalmitoyl-sn-glycero-3-phosphoglycerol; DOPG=1,2-dioleoyl-sn-glycero-3-phosphoglycerol:

The rate of release of an active agent (e.g. hyaluronan-degrading enzyme) from a liposomal formulation can be modified by selection of the amphipathic lipid, the accepted membrane forming lipid, by manipulation of the phospholipid/cholesterol ratio, by modulating the molar ratio of slow release and fast release neutral lipid components and/or by other factors known to one of skill in the art (see e.g. U.S. Pat. No. 5,962,016). For example, the neutral lipid component in the liposomes can be from 0% to 100% of slow and fast release components. For example, the neutral lipid component can be a mixture of a slow release neutral lipid and a fast release neutral lipid in a molar ratio range from about 0.0:1.0 to 1.0:0.0 such as from or about 1:1 to 1:100 or 1:4 to 1:18.

The release rate of the active agent (e.g. enzyme) can be determined or monitored. For example, release rates can be performed on lipid suspension in vitro in saline, a suitable buffer or in plasma or plasma-like medium incubated at varied temperatures (e.g. at least or about 4° C. or at least or about 37° C.) for varied times (e.g. at least 10 minutes, 30 minutes, 1 hour, 2 hours, 3 hours, 4 hours, 5 hours, 6 hours, 7 hours, 8 hours, 9 hours, 10 hours, 24 hours, 2 days, 3 days, 4 days, 5 days, 6 days, 7 days, 8 days, 9 days, 10 days, 30 days or more). After incubation for the designated time and/or temperature, the incubated tubes can be centrifuged and the supernatant solution collected and analyzed. Release rate of the enzyme can be determined, for example, by detection or quantitation of protein and/or hyaluronidase activity determination. In particular, conjugation of the enzyme to a label or other detectable moiety can aid in detection of the released enzymes. Exemplary of a detectable moiety is a fluorescent tag (e.g. GFP or Alexa488). Similar assays also can be performed in vivo. For example, a labelled or other detectable hyaluronan-degrading enzyme (e.g. Alexa488 PH20) can be encapsulated in a MVL suspension herein, and its release monitored directly in the local site of the prostate.

The particular release rate can be empirically modulated by altering the lipid components, concentration of hyaluronan-degrading enzyme, adding excipient and/or other parameters described herein or known in the art depending on the particular application of interest. Thus, the rate of release of the enzyme can be controlled. For purposes herein, the rate of release of the hyaluronan-degrading enzyme from the liposome formulations is such that the enzyme can counteract HA synthesis in the stroma of the prostate. Thus, the rate of release is sustained over time. The half-life of hyaluronidase and other hyaluronan-degrading enzymes is relatively short. Thus, since the enzyme disappears rapidly, a sustained release is needed for prolonged activity and hydrolysis of HA. Since HA in the stroma is regenerated every 3-10 days, it is necessary to maintain active enzyme in the local stroma to combat the effects of the HA.

As described herein above, any of the hyaluronan-degrading enzyme compositions described above in Section C, or known to one of skill in the art, can be encapsulated within the multivesicular liposomes. The concentration of the encapsulated enzyme can vary from about a few picomoles to about several hundred millimoles. The concentration of agent will vary depending upon such characteristics as the disease to be treated, the age and condition of the patient and the particular properties of the agent. Generally, the concentration of enzyme in solution in the first aqueous component during manufacture is directly proportional to the amount of enzyme that can be loaded in any given formulation. It is found herein, however, that protein concentration impacts encapsulation of hyaluronan-degrading enzyme, and in particular a PH20 hyaluronidase. For example, as exemplified herein, encapsulation processes with starting amounts of a hyaluronan-degrading enzyme of 2 mg/mL result in a decline in the activity and specific activity of the enzyme. Hence, formulations herein are prepared forming a first aqueous phase for encapsulation of a hyaluronan-degrading enzyme containing less than 2 mg/mL hyaluronan-degrading enzyme. For example, the first aqueous component generally contains less than 2 mg/mL hyaluronan-degrading enzyme, such as between or about between 0.1 to 1.9 mg/mL enzyme, for example 0.25 to 1.9 mg/mL enzyme, 0.5 mg/mL to 1.5 mg/mL, such as 0.75 mg/mL to 1.25 mg/mL and in particular at least or about 1 mg/mL hyaluronan-degrading enzyme but less than 2 mg/mL enzyme. The resulting MVL formulations contain between or about between 0.1 mg/mL to 1 mg/mL hyaluronan-degrading enzyme, for example 0.2 mg/mL to 0.5 mg/mL, such as at least or about 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL enzyme, and in particular at least 0.3 mg/mL enzyme concentration in a 50% liposome suspension in buffer or saline.

It is known also that pH can affect the solubility of active agents in the aqueous solution. For example, the solubility of IGF-I in aqueous solution drops precipitously at a pH of about 5 (see e.g. U.S. Pat. No. 6,306,432). Thus, typically in the art, to obtain and maintain sufficient agent in solution in the first aqueous solution, a buffer or acid also is added to it during manufacture to assure a high enough concentration. It is found herein, however, that higher pH ranges can be used, while still maintaining the solubility, activity and stability of the resulting encapsulated hyaluronan-degrading enzyme. For example, the pH of the first aqueous solution is between or about in the range of 6.0 to 7.5, 6.0 to 7.0 or 6.0 to 6.5, and in particular at least or about 6.0, such as at least or about 6.5.

Excipients also can be added to the first aqueous phase in order to increase the efficiency of encapsulation. In some examples, the added excipients modulate the rate of release of the active agent (e.g. hyaluronan degrading enzyme). In other examples, excipients can be added to enhance or preserve the stability of the encapsulated hyaluronan-degrading enzyme. Typically, excipients are added that both act to increase the efficiency of encapsulation and/or rate of release of the enzyme while also enhancing or preserving the stability of the encapsulated hyaluronan-degrading enzyme. The stability, encapsulation efficiency and release rate using any of a variety of excipients can be empirically determined. Methods of assessing encapsulation efficiency, stability and release rate are known to one of skill in the art.

For example, various types of osmotic excipients can be added. Both electrolytes and non-electrolytes function as osmotic excipients. In determining whether any particular molecule is an osmotic excipient or in determining the concentration of osmotic excipient in a solution, for example one encapsulated within a multivesicular liposome, consideration must be given to whether, under conditions within the solution (for example, pH), the molecule is wholly or partially ionized. It should also be determined whether such ions will permeate the lipid membrane (Mahendra K. Jain, van Nostrand Reinhold Co., *The Bimolecular Lipid Bilayer Membrane,* 1972, 470 pp.). One skilled in the art will appreciate that the osmotic excipient should be selected so as to avoid those that would prove toxic or otherwise harmful to a subject undergoing therapy by use of the liposome. Generally, osmotic excipients are selected that themselves do not have a biologic or therapeutic effect on a subject.

Generally, an osmotic excipient can be used to alter the osmolarity of the aqueous component into which the active agent is dissolved for encapsulation. An inverse relation between osmolarity and drug loading exists with the loading of active agent generally increasing as the osmolarity of the aqueous component decreases (U.S. Pat. No. 6,106,858). Osmolarity is the sum of the molar concentrations of solutes present in the aqueous solution, including any added excipients. Thus, for any selected concentration of hyaluronan-degrading enzyme that is used, drug loading during manufacture can be modulated by varying the contributions made by the excipients in the solution to the overall osmolarity of the first aqueous component.

Osmotic excipients include those that can facilitate the activity of the active agent, i.e. a hyaluronan-degrading enzyme. For instance, calcium ions can be co-encapsulated as a counterion to increase shelf life or facilitate bioavailability of the agent. In addition, various stabilizers can be used. Osmotic excipients that can be used to form multivesicular liposomes and to modulate the drug loading of the encapsulated agent from multivesicular liposomes include, but are not limited to, glucose, sucrose, trehalose, succinate, glycylglycine, gluconic acid, cyclodextrin, arginine, galactose, mannose, maltose, mannitol, glycine, histidine, lysine, citrate, phosphate, sorbitol, dextran and combinations thereof.

A hydrochloride can be added to either or both of the first aqueous components and the lipid component prior to the first emulsification. The addition of sufficient hydrochloride can be a factor in achieving high encapsulation efficiency and for controlled release rate of the encapsulated enzyme (see e.g. U.S. Pat. No. 5,723,147). Hydrochlorides that can be used include, but are not limited to hydrochloric acid, lysine hydrochloride, histidine hydrochloride, arginine hydrochloride, triethanolamine hydrochloride, pyridine hydrochloride and combinations thereof. Also, other hydrohalic acids, such as hydrochloric acid, hydrofluoric acid, hydrobromic acid, and hydroiodic acid can be used. For example, modulation of release rate of the encapsulated enzyme can be achieved by adjusting the concentration of hydrochloride present in either the lipid component or in the first aqueous used to form the water-in-oil emulsion during formation of the multivesicular liposomes to arrive at the desired release rate, i.e. a therapeutically effective release rate of the enzyme. It should be noted that, depending upon the concentration of hydrochloride used, the release rate of the enzyme from the multivesicular liposomes can either be increased or decreased over that achieved when the hydrochloride is not used in manufacture of the liposomes. The amount of hydrochloride used with any particular multivesicular liposome formulation will depend upon the chemical properties of the liposome (i.e. the combination of lipids used in the formulation), the aqueous solution encapsulated in the liposome, the environment into which the liposome is placed, as well as upon the particular enzyme encapsulated.

In another example, a non-hydrohalic acid can be added to either or both of the first aqueous components and the lipid component prior to the first emulsification. The addition of a non-hydrohalic acid can be a factor in controlling the rate of release of the enzyme from the MVL (see e.g. U.S. Pat. No. 5,766,627). The acids include, but are not limited to, perchloric acid, nitric acid, glucuronic acid, citric acid, formic acid, acetic acid, trifluoroacetic acid, trichloroacetic acid, sulfuric acid, phosphoric acid and combinations thereof. The amount of the acid used is that effective to provide a desired and controlled rate of release, in particular a rate of release that results in therapeutically effective levels of the encapsulated enzyme in the prostatic stroma. For example, the concentration of the non-hydrohalic acid in the lipid component or the first aqueous component to which is can be added can be at or between 0.1 mM to 0.5M, for example, 10 mM to 200 mM, such as at least 0.1 mM, 10 mM, 100 mM or 200 mM.

Other excipients that can be used include any that preserve or enhance the stability of the enzyme and/or increase the rate of encapsulation of the enzyme. It is found herein that hyaluronic acid (hyaluronan; HA) when included in the first aqueous phase increases encapsulation of the hyaluronan-degrading enzyme. The HA also preserves and/or enhances the stability of the hyaluronan-degrading enzyme. Hence, provided herein are MVL formulations that contain a hyaluronan-degrading enzyme and HA. Such MVL formulations are obtained by utilizing during manufacture a first aqueous component containing a hyaluronan-degrading enzyme a hyaluronic acid in a range from at or between about 1 mg/mL HA to 100 mg/mL HA, for example 10 mg/mL HA to 75 mg/mL HA, such as 15 mg/mL HA to 50 mg/mL HA, and in particular at least or about or 1 mg/mL HA, 2 mg/mL HA, 3 mg/mL HA, 4 mg/mL HA, 5 mg/mL HA, 6 mg/mL HA, 7 mg/mL HA, 8 mg/mL HA, 9 mg/mL HA, 10 mg/mL HA, 11 mg/mL HA, 12 mg/mL HA, 13 mg/mL HA, 14 mg/mL HA, 15 mg/mL HA, 16 mg/mL HA, 17 mg/mL HA, 18 mg/mL HA, 19 mg/mL HA, 20 mg/mL HA, 25 mg/mL HA, 30 mg/mL HA, 40 mg/mL HA, 50 mg/mL HA or more. In some examples, MVL formulations are obtained by utilizing during manufacture a first aqueous component containing a molar ratio of HA to hyaluronan degrading enzyme that is or is about 1:500, 1:400, 1:300, 1:200, 1:100, 1:90, 1:80, 1:70, 1:60, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, 20:1, 30:1, 40:1, 50:1, 60:1, 70:1, 80:1, 90:1, 100:1, 200:1, 300:1, 400:1, 500:1, or more. Depending on the encapsulation efficiency, the resulting MVL formulations contain encapsulated HA that is at least 5%, 10%, 15%, 20%, 30%, 40%, 50%, 60%, 70%, 80%, 85% or more of the HA used in the manufacturing process. For example, the resulting MVL formulations contain HA in an amount that is or between 0.05 mg/mL to 90 mg/mL, for example, 0.75 mg/mL to 13.0 mg/mL, such as 1 mg/mL to 10 mg/mL, generally at least 0.1 mg/mL HA. In some examples, the molar ratio of HA to hyaluronan degrading enzyme is or is about 1:500, 1:400, 1:300, 1:200, 1:100, 1:90, 1:80, 1:70, 1:60, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, 20:1, 30:1, 40:1, 50:1, 60:1, 70:1, 80:1, 90:1, 100:1, 200:1, 300:1, 400:1, 500:1, or more.

ii. Exemplary MVL—Hyaluronan-Degrading Enzyme Formulations

Provided herein are formulations that contain a hyaluronan-degrading enzyme, for example a hyaluronidase such as a PH20 or recombinant PH20, that is encapsulated in a multivesicular liposome (MVL). The MVL formulations are obtained by utilizing during manufacture a first aqueous component containing a concentration of dissolved hyaluronan-degrading enzyme less than 2 mg/mL hyaluronan-degrading enzyme, such as between or about between 0.1 to 1.9 mg/mL enzyme or 0.25 to 1.9 mg/mL enzyme, for example 0.5 mg/mL to 1.5 mg/mL, such as 0.75 mg/mL to 1.25 mg/mL and in particular at least or about 1 mg/mL hyaluronan-degrading enzyme but less than 2 mg/mL enzyme. The resulting MVL formulations contain between or about between 0.1 mg/mL to 1 mg/mL hyaluronan-degrading enzyme, for example 0.2 mg/mL to 0.5 mg/mL, such as at least or about 0.05 mg/mL, 0.1 mg/mL, 0.2 mg/mL, 0.3 mg/mL, 0.4 mg/mL, 0.5 mg/mL, 0.6 mg/mL, 0.7 mg/mL, 0.8 mg/mL, 0.9 mg/mL enzyme, and in particular at least 0.3 mg/mL enzyme in the suspension concentration.

In some examples, the first aqueous component used in making the formulation is at or near neutral pH. It is within the level of one of skill in the art to adjust the pH of a buffer or aqueous solution. Generally, the MVL formulations are obtained by utilizing during manufacture a first aqueous solution having a pH that is between or about in the range of 6.0 to 7.5, 6.0 to 7.0 or 6.0 to 6.5, and in particular at least or about 6.0, such as at least or about 6.5.

In other examples, the first aqueous component can contain one or more excipients, such as osmotic excipients. In particular, the excipients are those that increase the stability of the hyaluronan-degrading enzyme, increase the rate of encapsulation of the hyaluronan-degrading enzyme or that both increase stability and increase the rate of encapsulation of the hyaluronan-degrading enzyme. Non-limiting examples of excipients are sucrose, calcium chloride ($CaCl_2$), glycerol, dextran, PEG (e.g. PEG-6000), hyaluronic acid (HA), proline, Arg-HCl, sorbitol, trehalose, or human serum albumin (HSA) or combinations of any of the above. For example, exemplary MVL formulations are obtained by utilizing during manufacture a first aqueous component containing 1 mM to 50 mM $CaCl_2$, for example 5 mM to 25 mM $CaCl_2$, such as 10 mM to 20 mM $CaCl_2$, and in particular at least or about or 10 mM, 15 mM or 20 mM $CaCl_2$. In another example, exemplary MVL formulations are obtained by utilizing vortex mixer during manufacture a first aqueous component layered over an interphase containing 10 μl to 500 μl glycerol, for example 100 μl to 200 μl such as at least at or about or 150 μl glycerol in order to minimize initial exposure of hyaluronan-degrading enzyme to the organic solvent phase. In a further example, exemplary MVL formulations are obtained by utilizing during manufacture a first aqueous component containing between or about between 0.01% to 1% dextran (e.g. dextran 40,000), for example 0.05% to 0.5% dextran such as at least or about or 0.1% dextran. In other examples, exemplary MVL formulations are obtained by utilizing during manufacture a first aqueous component containing between or about between 0.01% to 1% PEG (e.g. PEG-6000), for example 0.05% to 0.5% PEG such as at least or about or 0.1% PEG. In another example, exemplary MVL formulations are obtained by utilizing during manufacture a first aqueous component containing between or about between 1 mM to 1 M proline, for example 10 mM to 500 mM proline such as at least or about or 100 mM proline. In a further example, exemplary MVL formulations are obtained by utilizing during manufacture a first aqueous component containing between or about between 1 mM to 1 M Arg-HCl (e.g. pH 6.44), for example 10 mM to 500 mM Arg-HCl such as at least or about or 100 mM Arg-HCl. In an additional example, exemplary MVL formulations are obtained by utilizing during manufacture a first aqueous component containing between or about between 1% to 20% sorbitol, for example 5% to 15% sorbitol, such as at least or about or 5%, 6%, 7%, 8%, 9%, 10% or more sorbitol. In some examples, exemplary MVL formulations are obtained by utilizing during manufacture a first aqueous component containing between or about between 1% to 20% trehalose, for example 5% to 15% trehalose, such as at least or about or 5%, 6%, 7%, 8%, 9%, 10% or more trehalose. It is understood that a combination of any of the above can be used.

In particular examples, MVL formulations are obtained by utilizing during manufacture a first aqueous component containing a hyaluronic acid (HA) in a range from at or between about 1 mg/mL HA to 100 mg/mL HA, for example 10 mg/mL HA to 75 mg/mL HA, such as 15 mg/mL HA to 50 mg/mL HA, and in particular at least or about or 1 mg/mL HA, 2 mg/mL HA, 3 mg/mL HA, 4 mg/mL HA, 5 mg/mL HA, 6 mg/mL HA, 7 mg/mL HA, 8 mg/mL HA, 9 mg/mL HA, 10 mg/mL HA, 11 mg/mL HA, 12 mg/mL HA, 13 mg/mL HA, 14 mg/mL HA, 15 mg/mL HA, 16 mg/mL HA, 17 mg/mL HA, 18 mg/mL HA, 19 mg/mL HA, 20 mg/mL HA, 25 mg/mL HA, 30 mg/mL HA, 40 mg/mL HA, 50 mg/mL HA or more. Depending on the encapsulation efficiency, the resulting MVL formulations contain encapsulated HA that is at least 1%, 5%, 10%, 15%, 20%, 30%, 40%, 50%, 60%, 70%, 80%, 85% or more of the HA used in the manufacturing process. For example, the resulting MVL formulations contain HA in an amount that is or between 0.05 mg/mL to 90 mg/mL, for example, 0.75 mg/mL to 13.0 mg/mL, such as 1 mg/mL to 10 mg/mL, generally at least 0.1 mg/mL HA.

The MVL formulations provided herein that encapsulate a hyaluronan-degrading enzyme are prepared containing a mixture of neutral lipids, a mixture of amphipathic lipids. Exemplary neutral lipids and amphipathic lipids for the lipid formulations are provided above. Generally, the formulations also contain cholesterol. In some examples, the formulations further contain DPPG. For example, the neutral lipid component contains a mixture of a slow release neutral lipid (e.g. triolein or other slow release neutral lipid) and a fast release neutral lipid (e.g. tricaprylin or other fast release neutral lipid) in a molar ratio range from 25/75 (slow/fast), 50/50, 75/25 or 90/10, and in particular 50/50. The amphipatic lipid component generally also is a mixture containing DEPC and DOPC in a molar ratio (DEPC/DOPC) of 50/50, 75/25 or 90/10 and in particular 50/50. For example, MVL formulations are obtained by utilizing during manufacture amphipathic lipids and neutral lipids in a volatile organic solvent in as a 50:50 mixture of a mixture containing 19.8 mM DEPC, 30 mM cholesterol, 3.75 mM triolein and a mixture containing 19.8 mM DOPC, 30 mM cholesterol and 3.75 mM tricaprylin. Exemplary MVL formulations are set forth in Table 19.

iii. MVL Co-Formulations

Provided herein are MVL co-formulations that further contain another therapeutic agent co-encapsulated with the hyaluronan-degrading enzyme. The other therapeutic agent can be any drug or agent known to one of skill in the art. The other agent can be hydrophilic or hydrophobic. Generally, in generating such liposome formulations, the procedures and parameters described above in Section D.2, and in particular subsections i. and ii. can be used. For example, the MVL formulations are generally prepared by utilizing during manufacture a mixture of neutral and amphipathic lipids. As described herein, the neutral and amphipathic lipids can each be provided as a mixture. Generally, the formulations also contain cholesterol. In some examples, the formulations further contain DPPG.

In some examples, the MVL co-formulations are prepared by mixing of a first aqueous component containing the hyaluronan-degrading enzyme and other agent with the lipid component in organic solvent. In other examples, the other agent is a hydrophobic drug and the MVL co-formulations are prepared by mixing of a first aqueous component containing the hyaluronan-degrading enzyme and with the lipid component in organic solvent that also contains the hydrophobic drug. It is found herein that inclusion of the hydrophobic drug with the lipid component in organic solvent results in encapsulation or intercalation of the hydrophobic drug into the lipid phase of the MVL. Hence, when generated in combination with a hyaluronan-degrading enzyme, the MVL formulations contain a hydrophilic and hydrophobic drug co-encapsulated in the same formulation, whereby the hyaluronan-degrading enzyme is in the aqueous phase and the hydrophobic drug is in the lipid phase. Any hydrophobic drug known to one of skill in the art can be co-encapsulated in an MVL formulation with a hyaluronan-degrading enzyme. Such hydrophobic drugs include, but are not limited to, docetaxel, prednisone, prednisolone, ibuprofen, clotrimazole, risperidone, tamoxifen citrate, diazepam, NPH insulin, a benzodiazepine, clofibrate, chlorpheniramine, dinitrate, digoxin, digitoxin, ergotamine tartrate, estradiol, fenofibrate, griseofulvin, hydrochlorothiazide, hydrocortisone, isosorbide, medrogestone, oxyphenbutazone, polythiazide, progesterone, spironolactone, tolbutamide, 10,11-dihydro-5H-dibenzo[a,d]cyclo-heptene-5-carboxamide, 5H-dibenzo[a,d]cycloheptene-5-carboxamide, 5α-reductase inhibitors such as finasteride or dutasteride, and others known to one of skill in the art.

With respect to generation of MVL co-formulations containing a hydrophobic drug, it is found herein that the morphology of the lipid co-formulation particles can be affected by the drug concentration and lipid concentration. It is within the level of one of skill in the art to determine the optimal concentrations of drug and lipids in order to obtain a particle of sufficient morphology for therapeutic applications while retaining activity of the active encapsulated drugs. The Examples exemplify procedures to assess and monitor morphology and activities.

In one example, MVL co-formulations are generated in which the concentration of hydrophobic drug is or is about 5 mg/mL or less than 5 mg/mL, and generally between or about between 0.1 mg/mL to 5 mg/mL. In addition, MVL co-formulations can be generated that utilize a high total lipid concentration during manufacture of the co-formulation. For example, in generating the co-formulations provided herein, the concentration of lipid can include an amount of an amphipathic lipid (e.g. DEPC or DOPC or mixtures thereof), that is greater than 20 mM, such as 20 mM to 100 mM, for example, 30 mM to 60 mM; an amount of a neutral lipid (e.g. triolein or tricaprylin or mixtures thereof) in an amount that is or is greater than 3 mM such as 4 mM to 20 mM, for example 5 mM to 12 mM; an amount of DPPG that is greater than 3 mM, such as 4 mM to 20 mM, for example 5 mM to 12 mM; and/or an amount of cholesterol that is greater than 15 mM, for example, 15 mM to 100 mM, such as 20 mM to 80 mM or 30 mM to 60 mM, such as at least 30 mM.

In particular examples herein, the other agent is an agent that is suitable for treating BPH as described herein. Such agents include any set forth in Section F below. For example, the agent can be an anti-androgen, such as a steroidal anti-androgen, a non-steroidal anti-androgen or 5α-reductase inhibitors; an alpha blocking agent such as an alpha1-adrenoreceptor antagonist; or *boutlinum* toxin or a modified *boutlinum* toxin. In particular examples, the other agent is the hydrophobic 5α-reductase inhibitors finasteride or dutasteride. For example, MVL formulations provided herein include those in which the hyaluronan-degrading enzyme is in the aqueous phase and finasteride or dutasteride is in the lipid phase. Exemplary MVL co-formulations are set forth in Example 8 herein and Table 20. Such MVL co-formulations can be used in the treatment of BPH as described herein.

iv. Assessing Encapsulation And Efficiency

Assays to assess the relative amounts of protein present in a liposome sample are known to one of skill in the art. For example, such assays include, but are not limited to, size exclusion chromatograph-HPLC (SEC-HPLC) to characterize high molecular weight proteins (HMWP), such as aggregates, and content analysis by RP-HPLC. In these examples, it is found herein that methods of extraction of hydrophilic protein drugs require particular detergents. For example, use of 1% sodium dodecyl sulfate (SDS) for content analysis by RP-HPLC. In another example, use of 1% octyl glucoside for SEC-HPLC analysis to characterize HMWP aggregates.

For example, encapsulation efficiency can be assessed by determining the content of the hyaluronan-degrading enzyme or other drug (suspension concentration and/or percent free concentration) of the resulting MVL formulation, for example, using RP-HPLC as described herein. The efficiency of encapsulation can be determined. The percent of encapsulation can be determined as the ratio of the amount of compound encapsulated in the final suspension of the liposome manufacturing process to the total amount of compound to be encapsulated used in the first aqueous solution of the process multiplied by 100. The percent of encapsulation generally is at least or is or is about 10%, 20%, 30%, 40%, 50%, 60%, 70%, 80%, 85% or more.

In other examples, the drug loading capacity can be determined, i.e. the amount of the active agent (e.g. hyaluronan-degrading enzyme or other drug) loaded into the product liposome suspension. It is a measure of the amount of active agent available in a unit volume of liposome formulation and is the ratio of encapsulated drug per unit volume of liposome suspension to the percent encapsulated volume in the liposomes themselves. It is approximately equal to the concentration of the active agent in the suspension divided by the lipocrit of the suspension for low percent free drug. The lipocrit is the ratio of volume occupied by the liposomes to the total suspension volume multiplied by 100.

In another example, the stability of the encapsulated hyaluronan-degrading enzyme or other drug can be determined by assessing the aggregation, solubility and/or activity of the active agent (e.g. hyaluronan-degrading enzyme, such as PH20, or other drug) in the formulations. For example, the activity of hyaluronan-degrading enzyme (total activity and/or percent free enzyme activity) can be determined as exemplified herein by assays that assess cleavage or degradation of the substrate. Such assays are known to one of skill in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbidity assay. This is based on the formation of an insoluble precipitate when hyaluronic acid binds with serum albumin. The activity is measured by incubating hyaluronidase with sodium hyaluronate (hyaluronic acid) for a set period of time (e.g. 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity. In another example, hyaluronidase activity is measured using a microtiter assay in which residual biotinylated hyaluronic acid is measured following incubation with hyaluronidase (see e.g. Frost and Stern (1997) *Anal. Biochem.* 251:263-269, U.S. Patent Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g. Delpech et al., (1995) *Anal. Biochem.* 229:35-41; Takahashi et al., (2003) *Anal. Biochem.* 322:257-263).

E. Dosage, Administration & Methods Of Treatment

Any of the above hyaluronan-degrading enzymes, in particular sustained release formulations of a hyaluronan-degrading enzyme, such as MVL formulations can be administered for the treatment of a hyaluronan-associated disease or condition. For example, any of the above hyaluronan-degrading enzymes, in particular sustained release formulations of a hyaluronan-degrading enzyme, such as MVL formulations can be administered for the treatment of benign prostatic hyperplasia (BPH).

The compositions and formulations can be administered by any desired route, for example, intratumoral, intra-articular (into joints), intra-ocular, intramuscular, intrathecal, intraperitoneal, subcutaneous, intravenous, intralymphatic, oral and submucosal and buccal (e.g., sublingual). Compositions provided herein typically are formulated for administration by intraprostatic route (transurethral, transperineal, and transrectal). Formulations suited for such routes are known to one of skill in the art. Administration can be local, topical or systemic. Local administration to an area in need of treatment can be achieved by, for example, but not limited to, local infusion during surgery, by injection, or instillation by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the progress of the disease, the severity of the disease, the particular composition(s) which are used for treatment. For purposes herein, it is desired that hyaluronidases and other agents are administered so that they achieve a high therapeutic concentration and are localized in the prostate. Thus, direct administration into the prostate, such as by intraprostatic injection, is contemplated. For example, local administration can be achieved by injection, such as from a syringe or other article of manufacture containing a injection device such as a needle. In another example, local administration can be achieved by infusion, which can be facilitated by the use of a pump or other similar device. Other modes of administration also are contemplated. Pharmaceutical composition can be formulated in dosage forms appropriate for each route of administration.

Administration of agents directly into the prostate is a procedure known to those of skill in the art. The preferred sites of injection in the hypertrophied prostate gland include the right and left lateral lobes and the medial lobe. The volume of the injection(s), whether one or more lobes is injected and the positions within each lobe can be determined by the attending physician either using the data on which the diagnosis of BPH was based or using information gathered by ultrasound equipment utilized to assist administration of the agents.

Intraprostatic injections are accomplished by means of a long, fine needle inserted into the prostate under digital rectal control and/or ultrasonic guidance. The injections are usually done under local anesthesia. The injection solution may be diluted with lidocaine. During the injection, the needle can be frequently relocated in order to obtain the best possible distribution of the composition(s). A typical volume of liquid or gel injected into the prostate is approximately 20-30% of the prostatic volume. Several routes of injection are available for the introduction of the disclosed composition into the prostate.

One route of administration is by means of transurethral intraprostatic (intralesional) injection. The transurethral technique is immediately preceded by catheterization. The volume, of the composition injected typically varies from 1 to 20 cc/lobe. To optimize the effects of the injected composition, it can be desirable to dilate the prostatic urethra with an inflatable balloon. The cystoscopically inserted balloon inhibits the immediate egress of the injected enzyme solution through the porous duct system that empties into the urethra. The advantage of this route of injection is that the method allows for direct cystoscopic visualization of the nodular areas of pathology and for the placement of a high concentration of the composition at the desired location without the risk of metabolic inactivation. The pain and discomfort experienced by patients during direct injection of the prostate typically are minimal and comparable to intramuscular injections.

Alternatively, the transperineal or transrectal routes of prostatic injection may be used. The transperineal route of injection involves the placement of 22 g×20 cm aspiration biopsy needle through the perineum into the prostate guided by ultrasound and/or digital palpation. Again, 1 to 20 cc of the disclosed composition is typically injected into each lateral lobe of the prostate. The injections are generally done under local anesthesia. During injection, the needle is frequently relocated to obtain the best possible distribution of the composition. The position of the needle may be guided by ultrasound while kept under constant digital rectal control. The transperineal route of injection may be a better alternative than either the transurethral or transrectal routes in terms of reducing potential complications due to post-injection bacterial infection.

The transrectal route allows needle introduction through the rectal wall and injection of the prostate while performing digital rectal palpation. Injection via the transrectal route can performed with a slightly curved 22 g×20 cm flexible aspiration biopsy needle. The use of a Franzen needle guide (Precision Dynamics, San Fernando, Calif.), for example, allows the needle to be safely directed into a suspected lesion under ultrasonic and/or tactile guidance techniques. The sterilized prostate needle guide is placed on a gloved index finger. A finger cot is placed over the needle guide. The index finger and needle guide are inserted into the rectum and suspected lesions of the prostate are palpated. The needle is inserted through the guide and advanced into the tissue. Approximately 1 to 20 cc of the solution can be injected into the lateral lobes of the prostate. In order to inject sufficient material, the needle can be moved back and forth three to five times. An anesthetic jelly can be applied before injection to reduce pain during needle puncture. Other devices are well known to one of skill in the art and can be applied and used in the instant methods. For example, a GelTx™-Intra-prostatic Gel Injection Treatment, in combination with ultrasound imaging (e.g. using a Trans-Rectal biplane probe) can provide excellent imaging guidance for injection needle placement (see e.g. ProSurg, San Jose, Calif.).

The concentration of the pharmaceutically active agent(s) is adjusted so that an injection provides an effective amount to produce the desired pharmacological effect. The exact dose depends on the age, weight and condition of the patient or animal as is known in the art. The unit-dose parenteral preparations are packaged in an ampoule, a vial or a syringe with a needle. The volume of liquid solution or reconstituted powder preparation, containing the pharmaceutically active agent(s), is a function of severity of the disease and the particular article of manufacture chosen for package. All preparations for parenteral administration must be sterile, as is known and practiced in the art.

Administration methods can be employed to decrease the exposure of selected agents to degradative processes, such as proteolytic degradation and immunological intervention via antigenic and immunogenic responses. Examples of such methods include local administration at the site of treatment. Pegylation of therapeutics has been reported to increase resistance to proteolysis, increase plasma half-life, and decrease antigenicity and immunogenicity. Examples of pegylation methodologies are known in the art (see for example, Lu and Felix, *Int. J. Peptide Protein Res.*, 43: 127-138, 1994; Lu and Felix, *Peptide Res.*, 6: 140-6, 1993; Felix et al., *Int. J. Peptide Res.*, 46: 253-64, 1995; Benhar et al., *J. Biol. Chem.*, 269: 13398-404, 1994; Brumeanu et al., *J Immunol.*, 154: 3088-95, 1995; see also, Caliceti et al. (2003) *Adv. Drug Deliv. Rev.* 55(10):1261-77 and Molineux (2003) *Pharmacotherapy* 23 (8 Pt 2):3S-8S). Pegylation also can be used in the delivery of nucleic acid molecules in vivo. For example, pegylation of adenovirus can increase stability and gene transfer (see, e.g., Cheng et al. (2003) *Pharm. Res.* 20(9): 1444-51).

Pharmaceutically therapeutically active agents and derivatives thereof are typically formulated and administered in unit dosage forms or multiple dosage forms. Each unit dose contains a predetermined quantity of therapeutically active agent sufficient to produce the desired therapeutic effect, in association with the required pharmaceutical carrier, vehicle or diluent. Examples of unit dose forms include ampoules and syringes and individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared.

Implantation of a slow-release or sustained-release system, such that a constant level of dosage is maintained (see, e.g., U.S. Pat. No. 3,710,795) is also contemplated herein. For example, any of the MVL formulations or other sustained release formulations can be administered. The percentage of active agent contained in such compositions is highly dependent on the specific nature thereof, as well as the activity of the agent and the needs of the subject. Controlled and sustained release formulations also can be provided in multiple and single dose forms.

For example, the lipid formulations, such as MVL formulations provided herein, are provided in a syringe. In some examples, the syringe has a single chamber containing the membrane vesicles. In other examples, the syringe has two chambers, whereby the membrane vesicles are in one chamber and another agent for treating BPH is in another chamber. The syringe can be for single use or for multiple use injection. In other examples, the formulations are provided in a sterile container, for example a single or multi-use container. If provided as a multi-use container, a preservative generally is included. Further, kits are provided containing a syringe or container and instructions for use.

In particular examples, a therapeutic agent that is administered in an amount or dosage regime that is therapeutically effective to ameliorate or reduce the symptoms of BPH. A therapeutically effective amount is the dosage sufficient to reduce one or more symptoms of BPH in a subject for at least a week, generally at least a month, for example, at least two months, three months, four months, five months, six months, seven months, eight months or longer. Indicators of improvement or successful treatment include the reduction in the size of the obstructive prostatic tissue and alleviation of symptoms of urinary obstruction. Objective assessment of the effects of therapy may be measured by standard methods, including urodynamic flow analysis, transurethral examination, transrectal ultrasonography or by an obstructive symptom scoring questionnaire such as the International Prostate Symptom Score (IPSS) or the American Urological Association Symptom Index Score (AUA Score).

The BPH therapeutic agent is provided in a therapeutically effective dose. Therapeutically effective concentration can be determined empirically by testing the compounds in known in vitro and in vivo systems, such as the assays provided herein. The concentration of a selected therapeutic agent in the composition depends on absorption, inactivation and excretion rates, the physicochemical characteristics, the dosage schedule, and amount administered as well as other factors known to those of skill in the art. For example, it is understood that the precise dosage and duration of treatment is a function of the tissue being treated and may be determined empirically using known testing protocols or by extrapolation from in vivo or in vitro test data. It is to be noted that concentrations and dosage values may also vary with the age of the individual treated. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. The amount of a selected BPH therapeutic agent(s) to be administered for the treatment of BPH, can be determined by standard clinical techniques. In addition, in vitro assays and animal models can be employed to help identify optimal dosage ranges.

Hence, the precise dosage, which can be determined empirically, can depend on the particular therapeutic preparation, the regime and dosing schedule, the route of administration and the seriousness of the disease. Hence, the precise dosages and amounts are known to one of skill in the art or can be determined empirically based on the literature or in vitro or in vivo (e.g. animal model) experiments. For example, the dosage or amount for intraprostatic administration can be a dosage and amount that is used for oral or intravenous administrations or the dosage or amount can be extrapolated from that dosage. One of skill in the art is familiar with dosage regimes for administration of particular BPH therapeutic agents.

A soluble hyaluronidase is provided in the combinations, formulations and compositions provided herein. The selected soluble hyaluronidase is included in an amount sufficient to exert a therapeutically useful effect. The therapeutically effective concentration can be determined empirically by testing in known in vitro and in vivo systems such as by using the assays provided herein or known in the art (see e.g., Taliani et al. (1996) *Anal. Biochem.*, 240: 60-67; Filocamo et al. (1997) *J Virology*, 71: 1417-1427; Sudo et al. (1996) *Antiviral Res.* 32: 9-18; Bouffard et al. (1995) *Virology*, 209:52-59; Bianchi et al. (1996) *Anal. Biochem.*, 237: 239-244; Hamatake et al. (1996) *Intervirology* 39:249-258; Steinkuhler et al. (1998) *Biochem.*, 37:8899-8905; D'Souza et al. (1995) *J Gen. Virol.*, 76:1729-1736; Takeshita et al. (1997) *Anal. Biochem.*, 247:242-246; see also e.g., Shimizu et al. (1994) *J. Virol.* 68:8406-8408; Mizutani et al. (1996) *J. Virol.* 70:7219-7223; Mizutani et al. (1996) *Biochem. Biophys. Res. Commun.*, 227:822-826; Lu et al. (1996) *Proc. Natl. Acad. Sci.* (USA), 93:1412-1417; Hahm et al., (1996) *Virology*, 226:318-326; Ito et al. (1996) *J. Gen. Virol.*, 77:1043-1054; Mizutani et al. (1995) *Biochem. Biophys. Res. Commun.*, 212:906-911; Cho et al. (1997) *J. Virol. Meth.* 65:201-207 and then extrapolated therefrom for dosages for humans.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms or based upon scheduled dosages.

In particular examples, MVL formulations, including co-formulations, or other lipid formulations provided herein are administered in dosage volumes for infection or infusion from at or about between 0.1 mL to 50 mL, for example, 0.5 mL to 10 mL such as 1 mL to 2 mL Generally, at least 1 mL of an MVL formulation or other lipid formulation encapsulated with a hyaluronan-degrading enzyme is delivered. The formulations can be injected into one site or multiple different prostatic sites. For example, 1 injection is made into each lobe of the prostate. For purposes of treatment of BPH, the MVL formulation is delivered via transrectal, transurethral or transperineal injection into the prostate under transrectal ultrasound. The MVL formulations are administered in a dosage regime at least once a month, once every two months, once every three months, once every four months, once every five months, once every six months, once every seven months, once every eight months, once every nine months, once every ten months, once every eleven months or once a year. For example, the MVL formulations are administered every 3 to 6 months.

F. Combination Therapy for the Treatment of Benign Prostatic Hypertrophy

Any of the above hyaluronan-degrading enzymes, in particular sustained release formulations of a hyaluronan-degrading enzyme, such as MVL formulations described above, can be administered together with one or more other agents suitable for treatment of BPH. The other agents can be administered sequentially (e.g. prior to or subsequently or intermittently) or simultaneously to the hyaluronan-degrading enzyme (e.g. MVL formulation containing an encapsulated hyaluronan-degrading enzyme). Hyaluronan-degrading enzymes and other therapeutic agents with complementary therapeutic modes of action enhance treatment of BPH if administered simultaneously or sequentially. For example, a hyaluronan-degrading enzyme, for example a hyaluronidase such as PH20, and in particular any encapsulated in a membrane vesicle as provided herein, can be combined with one or more of anti-androgens, alpha blockers, *boutlinum* toxins and other agents useful for treating BPH. Anti-androgens include, for example, steroid anti-androgens, non-steroid anti-androgens and/or 5α-reductase inhibitors. Any combination is contemplated. Further, as described above, sustained release formulations, such as MVL co-formulations, can be generated that additionally contain another therapeutic agent encapsulated therein, such as an agent suitable for treating BPH. Hence, in such examples, the hyaluronan-degrading enzyme and other agent are administered simultaneously upon delivery of the MVL co-formulations. Other agents suitable for treatment of BPH can additionally be administered in combination with an MVL co-formulation as provided herein.

As described herein below, other agents for the treatment of BPH are known in the art. Such agents can be used alone or in various combinations with the hyaluronan-degrading enzyme formulations provided herein. For example, combinations of BPH agents are known. Orally administered combinations of a 5α-reductase inhibitor and an alpha blocking agent, finasteride, and terazosin (U.S. Pat. No. 5,753,641), saw palmetto extract and terazosin (U.S. Pat. No. 6,200,573) and dutasteride and tamsulosin (GSK website) have been be used to treat BPH. Combination of a 5α-reductase inhibitor, such as finasteride, and a non-steroidal anti-androgen, such as flutamide or bicalutamide has been utilized for prostate cancer (U.S. Pat. No. 5,994,362). Also, *boutlinum* toxin has been used as an add on therapy with combination therapy. Patients receiving combination therapy of a 5α-reductase inhibitor and an alpha blocker that were given a single intraprostatic injection of *Botulinum* toxin A (200-600U) showed a reduction in prostate volume and improved urinary tract symptom scores compared to patients only receiving combination therapy within 6 months of treatment. At 12 months post treatment there was no observed difference between patients receiving combination therapy and those receiving combination therapy plus Botox add on therapy (Kuo et al, *Scand J Urol Nephrol.* 43(3):206 (2009).

Pharmaceutical compositions and combinations of compositions of hyaluronan-degrading enzyme with one or more BPH treatment agents are provided herein. The hyaluronan-degrading enzyme and the other agents can be administered separately or together. When formulated separately, the separate compositions can be administered sequentially, intermittently or subsequently from the other components. The BPH treatment agent and hyaluronan-degrading enzyme can be packaged as separate compositions for administration together, sequentially or intermittently. The combinations can be packaged as a kit.

The route of administration for the hyaluronan-degrading enzyme and other agents can be the same or different. For example, one agent is administered orally or intravenously and another agent is delivered by intraprostatic administration. For example, when hyaluronan-degrading enzyme is administered with an anti-androgen or an alpha blocking agent, the anti-androgen or alpha blocking agent can be given orally while the enzyme typically is administered intravenously or directly into the prostate. For purposes of treating BPH, a particularly useful mode of administering therapeutic combinations is by delivering the agents directly to the prostate as a co-formulation. A hyaluronan-degrading enzyme in combination with one or more of anti-androgens, alpha blocking agents, *boutlinum* toxin and other BPH therapeutic agents can be delivered directly to the prostate, e.g. via intraprostatic injection, transurethrally, transperineally or transrectally. As discussed herein, it is further advantageous to formulate such combinations of hyaluronan-degrading enzyme and one or more other agents so that once introduced into the prostate gland the agents are slowly released over an extended period of time resulting in a prolonged therapeutic effect and a reduction in the number of treatments required to achieve a therapeutic effect.

The dose of other therapeutic agents (e.g., anti-androgens, alpha blocking agents and *boutlinum* toxin) can vary depending on the of the condition, i.e., size of the prostate and the severity of the symptoms, the routes of administration, the patient and the particular combination of therapeutics that are being administered.

It is particularly advantageous to utilize concentrations and dosages of the hyaluronidase combined with other agents, specific formulations and modes of administration to reduce the number of treatments to the minimum number required to obtain the desired therapeutic effect. Intraprostatic injection of formulations of a hyaluronan-degrading enzyme provided herein combined with other therapeutic agents should allow treatment to be administered only monthly, quarterly, biannually, annually or optimally only a single time.

Also, it is understood that the precise dosage and duration of treatment for agents and combinations of agents can be determined empirically using known testing protocols or by extrapolation from in vivo or in vitro test data. It is to be noted that concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects). Administration of a therapeutic agent should not exceed the maximum dosage levels established by the United States Food and Drug Administration or published in the Physician's Desk References.

If necessary, a particular dosage and duration and treatment protocol can be empirically determined or extrapolated. For example, exemplary doses of orally or intravenously administered BPH therapeutic agents can be used as a starting point to determine appropriate dosages for direct injection into the prostate. For any of the BPH therapeutic agents, a particular dosage that is therapeutically effective can be estimated initially using a variety of techniques well known in the art. For example, a dose can be formulated in animal models to achieve a circulating concentration range that includes the $IC_{50}$ as determined in cell culture. Dosage range appropriate for human subjects can be determined, for example using data obtained from cell culture assay and other animal studies.

Dosage levels and regimens can be determined based upon known dosages and regimens or can be determined empirically based on a variety of factors. Such factors include body weight of the individual, general health, age, the activity of the specific agents employed, sex, diet, time of administration, frequency of administration, rate of excretion, specific combinations of the therapeutic agents, the severity and course of the disease, the patient's disposition to the disease, the desired reduction in symptoms, the judgment of the treating physician and other factors well known to affect the efficacy of administered pharmaceutical agents.

Exemplary other agents for the treatment of BPH are provided below. Agents for treatment of BPH are known to one of skill in the art. It is understood that the discussion of therapeutic agents for treatment of BPH provided below is for exemplification only. It is within the level of one skill in the art to use any agent for treatment of BPH in the compositions and combinations herein.

1. Anti-Androgens

The role of androgens in the development of benign prostatic hyperplasia in men is well documented (Wilson, *N. Engl. J. Med.* 317, 628 (1987)). In the prostate, testosterone is converted to the potent androgenic hormone 5α-dihydrotestosterone (DHT) by the enzyme 5α reductase. The enlargement of the prostate gland is dependent on DHT. DHT is bound to cytosol androgen receptors within the cytoplasm and the DHT-receptor complex is transported into the cell nucleus, where it effects transcription of genes involved in growth.

Anti-androgens are a broad class of agents that exert their effect by either interfering with the binding of androgens to the androgen receptor thus preventing the androgenic hormones from entering the nucleus and exerting their androgenic effect on the prostate or by interfering with the production of androgens. Anti-androgens that act through the androgen receptor are classified as steroidal or non-steroidal anti-androgens based on their chemical structure. Steroidal anti-androgens have the structure of a steroid, i.e. a tetracyclic hydrocarbon comprised of three cyclohexane and one cyclopentane rings. Non-steroidal anti-androgens do not have the chemical structure of a steroid.

Anti-androgens that competitively inhibit the action of androgenic hormones by binding to androgen receptors are one class of drugs that have been approved for treatment of BPH. These anti-androgen drugs include steroidal drugs and non-steroidal drugs.

a. Steroidal Anti-Androgens

Steroidal anti-androgen drugs include, but are not limited to, progestin compounds such as cyproterone acetate (CPA) (available outside the U.S. as Androcur® (Schering, Germany)) or Cyprostat® (Bayer, plc, United Kingdom), megestrol acetate (Megace®, Strativa Pharmaceuticals, Woodcliff Lake, N.J.), medroxyprogesterone acetate (Provera®, Pfizer, N.Y.), chlormadinone acetate (CMA) (available in Japan), Zanoterone (designated WIN 49596, LGM Pharmaceuticals, Inc., Boca Raton, Fla.), and osaterone acetate (TZP-4238) (Takezawa et al. *Prostate* 1992; 21(4):315-329; Takezawa et al. *Prostate* 1993; 27:321-328). Allylestrenol is a synthetic steroid with progestational activity that has been shown to be effective in the treatment of BPH (see Noguchi et al., *International Journal of Urology* 5(5):466-470 (1998)).

It is within the level of one of skill in the art to empirically determine a dose to be combined herein for use in treating BPH. A single dose of either 8 mg/kg or 25 mg/kg sustained release chlormadinone acetate (CMA-SR) was injected intraprostatically into rats (Goya et al. (2006) *Journal Compilation BJU International*, 99:202-206).

b. Non-Steroidal Anti-Androgens

Non-steroidal antiandrogen drugs include, but are not limited to, bicalutamide (Casodex®, AstraZeneca Wilmington, Del.), nilutamide (Nilandron®, Sanofi Aventis, Bridgewater, N.J.); Anandron® (Sanofi Aventis Australia Pty Ltd, Macquarie Park NSW 2113), flutamide (Eulexin®, Schering Laboratories, Kenilworth, N.J.); and RU 58642 (Battmann, et al., *J. Steroid Biochem. Mol. Biol.* 64, 103 (1998)). The non-steroidal antiandrogen RU 58841 (Kouting Chemical Co. Ltd., Shanghai) has been explored as a topical treatment for hair loss, but may also be effective in hormone therapy for prostate diseases.

The chemical name for bicalutamide is (±)N[4-cyano-3-(trifluoromethy)phenyl]-3-[(4-fluorophenyl)sulfonyl]-2-hydroxy-2methylpropanamide (described in U.S. Pat. No. 4,636,505 to Tucker, which is incorporated herein by reference). The R-enantiomer of bicalutamide has most of the activity. Dosage guidelines for Casodex® published in the

*Physician's Desk Reference* report that a typical dosage in a combination therapy (i.e., Casodex® in combination with an LHRH analogue) for prostatic carcinoma is once-daily oral administration of one 50-mg tablet. Dosages up to 200 mg per day are reported to be well-tolerated in long-term clinical trials.

Nilandron® has been approved for treatment of prostate cancer at a recommended dosage of 300 mg/day for 30 days, followed by 150 mg/day thereafter (see Nilandron Prescribing Information, products.sanofi-aventis.us/nilandron/nilandron.html).

Other suitable non-steroidal anti-androgens include non-steroidal anti-androgens described in U.S. Pat. No. 3,875,229 to Gold, U.S. Pat. No. 4,097,578 to Perronnet, et al., U.S. Pat. No. 4,239,776 to Glen, et al., U.S. Pat. No. 4,386,080 to Crossley, et al., U.S. Pat. No. 5,994,362 to Gormley, et al., or U.S. Pat. No. 5,872,150 to Elbrecht, et al. (the entire contents of each of which is herein incorporated by reference).

It is within the level of one of skill in the art to empirically determine a dose to be combined herein for use in treating BPH. For example, Nilutamide (Nilandron®) 150 Casodex 50 mg daily in combination with luteinizing hormone-releasing hormone analog for treatment of metastatic carcinoma of the prostate.

c. 5α-Reductase Inhibitors

Another class of anti-androgen drugs that have received approval for treatment of BPH are the inhibitors of the enzyme 5α-reductase. The enzyme 5α-reductase exists in two forms Type I and Type II. Type II is predominantly expressed in the prostate. Treatment with an inhibitor of 5α-reductase can reduce the production of DHT and slow the growth of prostatic tissue. Exemplary of 5α-reductase inhibitors include, but are not limited to, finasteride, dutasteride, FR146687 or PNU 157706. These 5α-reductase inhibitors, including finasteride and dutasteride, have been attributed with preventing the progression of growth of the prostate and the actual shrinking of the prostate.

Finasteride is a synthetic 4-azasteroid compound, and acts by inhibiting the Type-II form of 5α-reductase. Finasteride is available under the trade name Proscar® (Merck & Co., Inc., Whitehouse Station, N.J.). Finasteride has the chemical name (5α,17β)-N -(1,1-dimethethylethy)-3-oxo-4-azaandrost-1-ene-17-carboxamide. Finasteride inhibits 5α-reductase by forming a stable complex with the enzyme. Finasteride is reported to have no affinity for the androgen receptors in the cytoplasm. U.S. Pat. Nos. 4,220,735, 4,377,584, 4,760,071 and 4,859,681 to Rasmusson et al. describe the synthesis of finasteride and describe other suitable 4-azasteroid compounds useful for treating BPH. The dosage of finasteride can be determined by taking into consideration the mode of administration, the therapeutic effect of the hyaluronan degrading enzyme and other therapeutic agents included in the composition, the severity of the disease and is generally in accordance with accepted guidelines for treatment of BPH. By way of example, the recommended daily dosage of finasteride is 5 mg, administered orally.

Dutasteride (Duagen®, Avodart®, GlaxoSmithKline, Research Triangle Park, N.C.), (5α,17β)-N-[2,5-bis(trifluoromethy)phenyl]-2-oxo-4-azaandrost-1-ene-17-carboximide, is an approved synthetic 4-azasteroid drug that is reported to inhibit both Type I and Type II 5α-reductase. The recommended oral dose of dutasteride is 0.5 mg per day.

FR156687 is also an inhibitor that has been demonstrated to reduce the growth of the prostate in vivo and in vitro (see e.g. Nakayama et al. (1997) Prostate, 31:241-9). Another so-called "dual inhibitor" is designated PNU 157706, [N-(1,1,1,3,3,3-hexafluorophenyl-propyl)-3-oxo-4-aza-5α-androst-1-ene-17β-carboxamide] (diSalle, et al., *J Steroid Biochem. Mol. Biol.* 64, 179 (1998)).

The herbal supplement saw palmetto, has been taken for prostate health, and contains a 5α-reductase inhibitor.

It is within the level of one of skill in the art to empirically determine a dose to be combined herein for use in treating BPH. Finasteride is administered 5 mg/day orally for a treatment period of years (Lam et al. Urology, 2003 February; 61(2):354-8). Dutasteride (Avodart®) is administered 0.5 mg/day orally for a treatment period is years.

2. Alpha Blocking Agents

Alpha1-adrenoreceptor antagonists (α-blockers or a blocking agents) have been used in the treatment of BPH. Approved drugs include terazosin (Hytrin®, Deflox®, Abbott Laboratories, Abbott Park, Ill.), doxazosin (Cardura®, Pfizer, N.Y.), tamsulosin (Flomax®, Boehringer Ingelheim, Ridgefield, Conn.), alfuzosin (Uroxatral® Sanofi-Aventis, Bridgewater, N.J.), naftopidil (Flivas®, Asahi Kasei Pharma Corp., Tokyo, Japan) and silodosin (Rapaflo®, Watson Pharmaceuticals, Inc, Corona, Calif.)). These drugs act to relax the smooth muscle of the prostate and bladder neck, reducing urethral resistance and producing improved urine flow. Alpha1-adrenoreceptor antagonists treat only the symptoms of BPH and do not reduce the size of the prostate.

It is within the level of one of skill in the art to empirically determine a dose to be combined herein for use in treating BPH. For example, the minimum/maximum daily oral dose of terazosin is 1.0 mg/20.0 mg; Silodosin is administered orally at 8 mg/day; Alfuzosin (SR, sustained release) is administered at 5 mg twice a day (Debruyne et al. *Eur Urol* 1998; 34:169-175); Tamsulosin (Flomax®) has an effective oral dose of 0.4 mg per day or 0.8 mg per day. Hytrin oral dosing is gradually increased from 1 mg/day to 2 mg/day to 5 mg/day.

Typically when more than one BHP therapeutic has been administered at the same time to a patient, such a 5α-reductase inhibitor and an alpha blocking agent, each agent has been provided at the dose given when it is administered alone. Dutasteride a 5α-reductase inhibitor 0.5 mg/day and tamsulosin an alpha blocker 0.4 mg/day 3. *Botulinum* Toxin and Modified *Botulinum* Toxins

*Botulinum* toxin has been used in the treatment of BPH to reduce the size of the enlarged prostate. One hundred units of *boutlinum* toxin type A formulated in 20% Poloxamer 407 (BASF, Florham Park, N.J.) in 0.9% sodium chloride for sustained release when injected transperineally into each of the bilateral lobes of the prostate resulted in beneficial effects for about six months (US Application No. 20090214685)

*Botulinum* toxin includes the neurotoxin produced by *Clostridium boutlinum*; the *boutlinum* toxin (or the light chain or the heavy chain) made recombinantly by a non-Clostridial species; the *boutlinum* toxin serotypes A, B, C, D, E, F and G; a *boutlinum* toxin complex (the 300, 600 and 900 kDa complexes); a modified *boutlinum* toxin, pegylated *boutlinum* toxin, chimeric *boutlinum* toxin, recombinant *boutlinum* toxin, hybrid *boutlinum* toxin and chemically-modified *boutlinum* toxin. A modified botulism toxin is a botulism toxin that has at least one of its amino acids deleted, modified, or replaced, as compared to a native *boutlinum* toxin. A modified *boutlinum* toxin can be a recombinantly produced neurotoxin, or derivative or fragment of a recombinantly made neurotoxin. A modified *boutlinum* toxin retains at least one biological activity of the native *boutlinum* toxin.

Commercially available *boutlinum* toxin containing pharmaceutical compositions include Botox®, *Botulinum* toxin type A neurotoxin complex in human serum albumin and sodium chloride (Allergen, Inc., Irvine, Calif.); Dysport®,

*Clostridium boutlinum* type A toxin haemagglutinin complex with human serum albumin and lactose, (Ipsen Limited, Berkshire, U.K.) and Myobloc®, *boutlinum* toxin type B, human serum albumin sodium succinate and sodium chloride (Solstice Neurosciences, Inc., South San Francisco, Calif.).

*Botulinum* toxin useful for the compositions herein include *boutlinum* toxin type A, *boutlinum* toxin type B, *boutlinum* toxin type C, *boutlinum* toxin type D, *boutlinum* toxin type E, *boutlinum* toxin type F, and *boutlinum* toxin type G. Preferred *boutlinum* toxins to use includes *boutlinum* toxin type A and *boutlinum* toxin type B. Other forms of *boutlinum* toxin that are useful are chimeric or hybrid *boutlinum* toxins, see, e.g., U.S. Pat. No. 5,939,070, which is incorporated by reference herein in its entirety; recombinantly made *boutlinum* toxins, see, e.g., U.S. Pat. No. 5,919,665, which is incorporated by reference herein in its entirety; and retargeted *boutlinum* toxins, see, e.g., U.S. Pat. Nos. 5,989,545 and/or 6,461,617, which are incorporated by reference herein in their entirety. Retargeted *boutlinum* toxins refer to *boutlinum* toxins that are attached to a non-native targeting moiety with affinity for the selected target tissue. Formulations of *boutlinum* toxin that are compatible with the combinations herein include depot formulations, e.g., polymeric implants, microspheres, wafers, and gels, for sustained or controlled release. See, e.g., U.S. Pat. Nos. 6,585,993; 6,506,399; 6,306,423; 6,312,708; 6,383,509, all of which are incorporated herein by reference in their entirety.

Typically, the amount of *boutlinum* toxin administered to a patient is from about 1 to about 2000 units of *boutlinum* toxin type A or from about 50 to about 25,000 units of *boutlinum* toxin type B.

The preparation and use of *boutlinum* toxin is described in U.S. Pat. Nos.: 7,579,010, 7,556,817, 7,491,799, 7,491,403, 7,465,457, 7,455,845, 7,452,697, 7,449,192, 7,445,914, 7,262,291, 7,223,577, 7,189,541, 7,148,041, 7,041,792, 5,955,368, 5,837,265 and 5,696,077, which are incorporated by reference in their entirety.

It is within the level of one of skill in the art to empirically determine a dose to be combined herein for use in treating BPH. For example, published U.S. Pat. No. 7,153,514 describes single treatment of benign prostatic hyperplasia single treatment by three intraprostatic injections of 50 units of hyaluronidase followed by three injections of 50 units of *boutlinum* toxin type A injections. In another example, treatment of BPH is by injecting into the prostate 100 IU/70 kg to 1200 IU/70 kg of *boutlinum* toxin type A as a single or divided dose (see e.g. U.S. Pat. No. 7,153,514). See also Chuang et al. *Journal Compilation BJU International* 98:28-32 (2006).

4. Other Agents

Other agents that are useful for the treatment of BPH can be administered with a hyaluronan-degrading enzyme (e.g. hyaluronidase) formulation, and in particular a sustained release formulations, in place of or along with the anti-androgens, alpha blocking agents and *boutlinum* toxins. The following are some examples of other agents useful for the treatment of BPH and is not intended to be limiting.

PRX302 is a PSA activated bacterial protoxin that can be injected intraprostatically to treat BPH. (Protox Therapeutics; see www.protox.com WO2006/133553).

Conjugates useful to treat BPH include oligopeptides with amino acid sequences which are selectively cleaved by PSA, chemically linked to vinca alkaloid cytotoxic agents (USP 20040081659).

NX-1207 (2.5 mg) is administered by intraprostatic injection, single treatment (Nymox Pharmaceuticals).

Cernilton®-pollen extract has been show to improve urine flow and decrease prostate volume when given to patients with BPH (see Dutkiewicz, *International Urology and Nephrology* 28(1):49-53 (1996).

Elocalcitol is a nonhypercalcemic vitamin D agonist has been demonstrated to arrest prostate growth when administered orally at a dose of 150 mcg/day (see BioXell website, www.bioxell.com).

Ethanol ablation can be used in the treatment of BPH (see e.g. Ditrolio et al. (2002) *Journal of Urology,* 167:2100-2104; Grise et al. (2004) *Eur. Urol.,* 46:496-501). Hence, in examples herein a hyaluronan-degrading enzyme (e.g. hyaluronidase) formulation, and in particular a sustained release formulations, can be used in concert with ethanol ablation to treat BPH.

5. Articles of Manufacture

Pharmaceutical compounds of selected therapeutic agents can be packaged in combination with a hyaluronan-degrading enzyme formulation as articles of manufacture containing packaging material, a pharmaceutical composition which is effective for treating BPH, and a label that indicates that the selected agent(s) is to be used for treating the disease or disorder. Combinations of a hyaluronan-degrading enzyme formulation and one or more of anti-androgens, alpha blocking agents, *boutlinum* toxin and other BPH treatment agents can be packaged in an article of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. The articles of manufacture can include a needle or other injection device so as to facilitate administration for local injection purposes. A wide array of formulations of the compounds and compositions provided herein are contemplated as are a variety of treatments for BPH.

The choice of package depends on the hyaluronan-degrading enzyme and other agents, and whether such compositions will be packaged together or separately. In general, the packaging is non-reactive with the compositions contained therein. In one example, the hyaluronan-degrading enzyme can be packaged as a mixture with one or more of anti-androgens, alpha blocking agents, *boutlinum* toxins and other BPH treatment agent. For example, a sustained release formulation of a hyaluronan-degrading enzyme and a 5α-reductase inhibitor, such as finasteride or dutasteride, is contemplated. In other examples, some of the components can be packaged as a mixture. In other examples, all components are packaged separately. Thus, for example, the components can be packaged as separate compositions that, upon mixing just prior to administration, can be directly administered together. Alternatively, the components can be packaged as separate compositions for administration separately.

The components can be packaged in a container. The container can have a single compartment containing a hyaluronan-degrading enzyme formulation and being amenable to addition of one or more of the other agents by the user, for example through an opening in the compartment. Any container or other article of manufacture that is amenable to having a defining space for containment of hyaluronidase and that is amenable to simple manipulation to permit addition of the final components is contemplated. The other components are added prior to use.

In other examples, the components are separately packaged in the same container. Generally, examples of such containers include those that have an enclosed, defined space that contains hyaluronidase, and a separate enclosed, defined space containing the other components or component such that the subsequent areas are separated by a readily removable membrane which, upon removal, permits the components to mix. Any container or other article of manufacture is contemplated, so long as the hyaluronidase is separated from the other components prior to administration. For suitable embodiments see e.g, containers described in U.S. Pat. Nos. 3,539,794 and 5,171,081.

For example, a single chamber apparatus includes those in which the apparatus contains a single chamber or container and, if needed, ejection means. Single chamber housings or containers include any item in which a hyaluronidase is included in the container. The hyaluronan-degrading enzyme is housed in the vessel in liquid phase or as a powder or other paste or other convenient composition. The other components, e.g, anti-androgen, alpha blocking agent or *boutlinum* toxin are introduced just prior to use or are administered separately.

In other examples, an apparatus contemplated for use herein is a dual-chamber or multi-chamber container. In general, this apparatus has at least two chambers or compartments thereby maintaining the hyaluronan-degrading enzyme separate from the anti-androgen and/or alpha blocking agent or *boutlinum* toxin until mixture is desired. The apparatus can include a mixing chamber to permit mixing of the components prior to dispensing from the apparatus. Alternatively, mixing can occur by ejection of one component from one chamber into a second chamber containing the hyaluronidase. For example, the hyaluronan-degrading enzyme can be provided in lyophilized form, and reconstitution can be achieved by ejection of the anti-androgen or alpha blocking agent, such in a liquid solution, from a first chamber into the second chamber containing the lyophilized hyaluronidase.

In some examples, a dual-chamber or multi-chamber apparatus employs a mechanical pump mechanism in its operation. In such an example, the dispensing apparatus maintains the components in separate chambers. A pump mechanism operated to withdraw the contents from each chamber and into a mixing chamber, or from one chamber into the second chamber. The pump mechanism can be manually operated, for example, by a plunger. Exemplary of such dual chamber apparatus include dual chamber syringes (see e.g., U.S. Pat. Nos. 6,972,005, 6,692,468, 5,971,953, 4,529,403, 4,202,314, 4,214,584, 4,983,164, 5,788,670, 5,395,326; and International Patent Application Nos. WO2007006030 and WO2001047584).

Another example of a dual-chamber or multi-chamber fluid dispensing apparatus contemplated for use herein takes the form of a compressible bottle or tube or other similar device. The device has at least two compartments within it that keep the components separated. The cap of the device can serve as a mixing chamber, a mixing chamber can be positioned between the two chambers and the cap, or mixing can be achieved within one of the chambers. The components are forced by compression from the separate compartments into the mixing chamber. They are then dispensed from the mixing chamber. For example, the mixed contents can be removed from the device by attaching a plunger/syringe apparatus to the dispensing end and withdrawing the contents there through. Such devices are known in the art (see e.g., International Patent Application. No. WO1994015848).

6. Kits

Selected compositions and combinations of a hyaluronan-degrading enzyme, and one or more of an anti-androgen, alpha blocking agent, *boutlinum* toxin or other BPH therapeutic agent, including articles of manufacture thereof also can be provided as kits. Kits can include a pharmaceutical composition described herein and an item for administration provided as an article of manufacture. For example, a hyaluronan-degrading enzyme and one or more of anti-androgens, alpha blocking agents, *boutlinum* toxins and other BPH therapeutic agents can be supplied with a device for administration, such as a syringe. The compositions can be contained in the item for administration or can be provided separately to be added later. For example, a pre-filled single use syringe with 1-2 ml of a formulated hyaluronan-degrading enzyme and anti-androgen, such as finasteride is contemplated. Generally, kits contain an item with a hyaluronan-degrading enzyme formulation or composition, and an anti-androgen composition and/or alpha blocking agent and/or *boutlinum* toxin composition. The kit can, optionally, include instructions for application including dosages, dosing regimens and instructions for modes of administration. Kits also can include a pharmaceutical composition described herein and an item for diagnosis. For example, such kits can include an item for measuring the concentration, amount of PSA in the subject.

G. Methods of Assessing Efficacy

A major goal of treating BPH is to alleviate urinary outflow obstruction and the accompanying symptoms. The reduction in size of the obstructive prostatic tissue and the subsequent alleviation of symptoms of urinary obstruction are indicative of successful therapy. Fundamental to the role played by the compositions and methods provided herein, is the methodology involved in the evaluation of the therapy. Objective assessment of the effects of the therapy may be measured by standard methods including urodynamic flow analysis, transurethral examination, or transrectal ultrasonography in conjunction with an obstructive symptom scoring chart.

To assess the role of the present methods, compositions and combinations in relieving obstructive symptoms of BPH, accurate means of quantifying prostatic size and determining peak urinary outflow are essential. Evaluation of the response to treatment of BPH should be based upon objective criteria. Current prostatic imaging techniques and methods of urodynamic analysis have proven effective in the evaluation of therapeutic treatments for BPH. In view of the variability of the clinical course of BPH in general and within the individual patient in particular, the need exists for extended baseline evaluations before and after therapy. Initial patient evaluation should include: history; physical; symptom scoring; cystoscopy; complete blood count and biochemical profile; measurement of residual urine; and urinary flow rate. Prostate size may be determined with three dimensional transrectal ultrasonography. Following a course of treatment, follow-up evaluation should be performed. Post-therapy follow-up of patients treated for prostatic hypertrophy may include: physical examination; cystoscopy; laboratory studies; and imaging procedures. Patients considered to have benefited from therapy are those who have clinical improvement such as with respect to peak urinary flow rates and symptom scores.

A convention for estimating prostate size on physical examination involves a grading scale ranging from normal through 4+. A normal gland is approximately the size of a horse chestnut, weighs approximately 10 gm and presents as a minimally perceptible impression on rectal examination. A 1+ enlarged prostate is about the size of a plum, weighs about 25 gm and occupies a bit less than one fourth of the rectal lumen. A 3+ enlarged prostate attains the size of an orange, achieves a weight of approximately 75 gm and fills approximately three fourths of a rectal diameter. A 4+ gland may attain the size of a small grapefruit, weigh in excess of 100 gm and fill so much of the rectal lumen that adequate examination is difficult.

Recent advances in ultrasonic imaging instrumentation and techniques have proven useful in the diagnosis, staging, and treatment of diseases involving the prostate. Three dimensional imaging techniques employing transrectal (TRUS) or transurethral ultrasonic scanning equipment have been shown to be accurate and valuable in assessing the local response of the prostate to treatment. A probe is inserted into the anus to check the prostate. The probe is used to bounce sound waves off internal organs to produce a sonogram. Sonographic voiding studies provide more clinically useful information than the conventional studies that are currently employed. Additionally, the use of transrectal ultrasonography improves the accuracy of prostatic injections by allowing placement of the needle, under ultrasonic guidance, directly into suspicious areas. Transrectal ultrasonography of the prostate allows the anterior portions of the prostate, which cannot be digitally palpated, to be visualized. Intraprostatic anatomy, integrity of the capsule, and seminal vesicles can be also imaged.

The use of transrectal ultrasonography in the determination of prostatic volume has been proven to be a reliable method and has been shown to be accurate to within 5% of the actual prostatic weight. The specific gravity of the prostate is close to 1.0 and the prostatic volume in cubic centimeters is considered equal to its weight in grams. Prostatic weight may be calculated using the simple formula: Weight=0.5 (D1×D2×D3) with D1, D2, and D3 representing diameters of the three dimensions of the prostate. Day-to-day reproducibility of this technique is believed to be about 95%. Other imaging procedures that may be employed include urinary tract pyelograms, computed tomography, and magnetic resonance imaging techniques.

Intravenous pyelograms are of limited value in assessing prostatic size. Computed tomography can reveal the periprostatic area and reveal lymph node size. Intraprostatic detail, however, is poor with masses rarely visualized. The detection of enlarged nodes is highly sensitive; however, normal sized nodes may contain microscopic carcinoma. Magnetic resonance imaging, like transrectal ultrasound, reveals intraprostatic anatomy. The technique is as accurate and sensitive as transrectal ultrasound or computed tomography in demonstrating pelvic adenopathy, periprostatic invasion, and seminal vesicle involvement.

1. Animal Models

In vivo mammalian model systems developed to evaluate BPH therapy should provide data regarding effective dosages as well as information about potential toxic or immunologic side effects. Of the experimental animals, the canine has been considered the most appropriate model for the study of human BPH. The large size of the canine prostate as well as the spontaneous occurrence of BPH in older dogs provide analogies with the human system. In spite of morphological and biochemical differences, the canine prostate offers a suitable experimental model for evaluating the effects of therapy.

In vivo studies can be designed to evaluate the safety and effectiveness of the described compositions and method of administration in the canine animal model. The effect on prostatic tissue caused by the in vivo intraprostatic injection of the compositions can be evaluated by in vivo and in vitro ultrasonic scans of the prostate and by the gross and microscopic examination of necropsy tissue. Histopathological evaluation of the effects of the injected composition included examination of the prostate, urethra, bladder, testes, kidneys, liver, heart, and lungs. Additionally, evidence of strictures, fistulas, adhesions, and granulomas can be examined in tissues neighboring the injection site. Following a course of in vivo intraprostatic injections of the compositions to be tested, according to an approved GLP protocol for in vivo canine studies, the animal can be euthanized with an overdose of sodium pentobarbital. The prostate can be exposed by a midline incision, removed, trimmed of excess debris, and weighed. Upon removal, the prostate is placed in a container with normal saline and then scanned ultrasonically. The ultrasonic images of the prostate are recorded on film. The ultrasonic scans are performed so that the ultrasonic and histological findings could be compared in the same areas as accurately as possible. After the scan, the entire prostate can be serially sectioned into 0.5 cm slices, photographed, and prepared for microscopic histopathological examination. Care should be taken to preserve the correct anatomical orientation for comparison with the ultrasonograms. When the prostate is scanned in vitro, there was no intervening tissue between the transducer and target tissue and thereby provided an optimal ultrasonic image. The ultrasonic patterns of the in vivo prostate scans is not identical to the pattern obtained in vitro due to the circulation of blood and intervening tissues. However, comparisons can be made and good correlations found between the in vivo and in vitro ultrasonic scans.

Due to limitations in extrapolating data obtained from animal experiments to human conditions, the ultimate evaluation of any biological therapeutic agent should be performed on humans. The results of relieving urinary obstruction secondary to BPH by surgical methods currently in use are good. Nonsurgical methods, to be acceptable, must provide equally effective results and be free from untoward side effects. Properly constructed clinical trials are essential and difficult to perform in an elderly population due to limitations in monitoring the course of the disease and its response to therapy over long periods of time. Clinical studies evaluating therapy must include placebo controlled double blind measurements continuing for at least three years post treatment. The effects of the treatment may vary with the proportion of stromal and epithelial components or upon the dose and duration of the treatment. In order to more objectively select candidates for treatment with the nonsurgical method of therapy and to more accurately monitor the effects of the disclosed composition, the necessary criteria for men with BPH to qualify as candidates for drug therapy should include moderate to severe symptoms with peak urinary flow rates less than 15 mL/second. Patients to be excluded are those with prior prostatectomy, acute urinary retention, infection, neurogenic bladder, urethral stricture, carcinoma of the prostate, or other life threatening illness.

Clinical studies involving human subjects may involve one or more of the following parameters in order to establish the optimal mode of therapy for the treatment of BPH. The prospective patient population exhibiting quantitative obstructive symptoms due to BPH is screened and suitable candidates for therapy are selected. Selected patients are skin-tested for allergic reactions by the intradermal injection of 0.1 cc of a pharmaceutically acceptable solution of the therapeutic agents. Intralesional prostatic injections with various combinations and concentrations of agents are performed. Suitable and effective amounts of the therapeutic agents can be determined from studies which vary in terms of: concentration, combination, formulation of the therapeutic agents, volume of injection, location and number of injections required for the relief of obstructive symptoms. Experimental therapy should be terminated when the desired reduction of prostatic tissue is achieved or when no further improvement in symptoms between treatments is observed.

2. In Vitro Procedures

In vitro studies included the injection of prostatic tissue in commercially available, prostatic tissue chips obtained from the guinea pig, canine, and human, surgically excised, whole organ specimens of guinea pig and canine prostates.

Specimens of human prostatic tissue from individuals exhibiting BPH (which may be obtained from autopsies, cadaver organ transplant donors, or patients undergoing prostatectomy) can also be injected with therapeutic agents. Treated samples can be evaluated by means of standard bright-field, epifluorescent, and phase-contrast microscopy.

Procedures for the preparation of frozen tissue sections stained with hematoxylin and eosin have been developed in order to compare and evaluate the microscopic histologic changes in prostatic tissue caused by the intraprostatic injection of various therapeutic agents. For histological examination, the prostate is serially divided into approximately 0.5 cm cross-sections. It is important that these cross-sections traverse the mid-portion of the prostate and include portions of the prostatic urethra. All sections should include the urethral mucosa and the outer margin of the prostatic capsule. The tissue cross-sections are frozen at −20° C., mounted on a pre-cooled cryostat chuck, and 8 lm thin frozen sections are prepared in a cryostat at −40° C. The thin sections are thaw-mounted on microscope slides, immediately fixed in 95% ethanol, stained with hematoxylin and eosin, and cover-slipped with Permount (Fisher, Pittsburgh, Pa.). Alternatively, the tissue cross-sections may be immediately fixed in 4-10% formality pH 7.2, embedded in paraffin, serially thin sectioned, mounted, and stained with hematoxylin and eosin. Thin tissue sections are obtained every 100 lm with a total of at least 20 thin sections microscopically examined for each prostate. Prostatic tissue is cross-sectioned with a scalpel and frozen for thin sectioning in a cryostat. The tissue cross-sections may be frozen at −20° C. or snap frozen at −80° C. by immersion in dry-ice/acetone solutions. If thin sectioning is to be delayed, the tissue may be stored in a sealed container for several days at −20° C. Prior to thin sectioning, the frozen tissue cross-sections are brought to cutting temperature (−30 to −40° C.) by placing them in the cryostat for at least one hour. Microscope slides are cleaned by dipping in 70% to 95% ethanol. Thin frozen sections suitable for H & E staining (6 to 8 lm thick) are prepared in a cryostat. The cutting temperature, knife blade angle and sharpness, and ambient humidity all influence the quality of thin sections. If the temperature is too low, the tissue tends to fracture and shred. If the temperature is too high, the sections tend to curl up and stick to the knife blade. Low humidity seems to prevent curling of the sections on the knife blade resulting in less distortion of tissue morphology. As the tissue sections come off the knife blade, they can be helped onto the microscope slide with a small camel hair artist's brush. Storing the clean slides at room temperature also aids in picking the tissue sections off of the knife blade and in melting the section to the slide. The prepared slides are immediately fixed in 95% ethanol at 22° C. and subject to the protocol for H & E staining of frozen sections.

The Hematoxylin and Eosin (H & E) staining procedure for frozen sections can be performed as follows using solutions of Harris hematoxylin (James Phillips Co., Minneapolis, Minn.), Lerner Eosin Y (Baxter, McGaw Park, Ill.), 1% lithium carbonate (Sigma), and Americlear (Baxter). Frozen tissue sections (8 lm) are fixed in 95% ethanol for 1 to 30 minutes. The slides are treated to the following steps:

Rinsed in deionized $H_2O$ for 30 seconds;
Stained in hematoxylin for 1 minute; washed in warm tap $H_2O$ for 15 seconds;
Dipped in dilute $Li_2CO_3$, 2-4 dips (50 11 1% $Li_2CO_3$ into 50 ml deionized $H_2O$);
Washed in deionized $H_2O$ for 15 seconds;
Dipped in eosin Y, 10 dips; dipped in 70% ethanol, 5 dips;
Dipped in 95% ethanol, 5 dips; dipped in 100% ethanol, 10 dips;
Again dipped in 100% ethanol, 10 dips;
Dipped in Americlear, 10 dips;
Again dipped in Americlear, 10 dips; and
Immediately coverslipped with Permount.

H. Examples

The following examples are included for illustrative purposes only and are not intended to limit the scope of the invention.

Example 1

Hyaluronic Acid Expression in Human BPH Tissue

In this example, the expression of hyaluronic acid (HA) in both human normal and benign prostatic hyperplasia (BPH) prostate tissue samples was analyzed by histological staining with HA-binding protein (HABP) and 3,3'-diaminobenzidine (DAB) peroxidase substrate.

Pre-cut histology paraffin (FFPE) tissue sections were obtained from US BioMax Inc (Cat No. PR804, PR806 and PR808, Rockville, Md.). In brief, BPH and normal prostate tissues were fixed in 10% neutral buffered formalin in PBS for 24 hours, dehydrated with gradient ethanol, cleared with xylene, and embedded in paraffin. Tissue sections were dew-axed, rehydrated and then incubated with 3% bovine serum albumin (BSA) at 37° C. for 30 minutes. After rinsing with calcium and magnesium free phosphate buffered saline (PBS-CMF), 0.3 mL of biotinylated HA-binding protein (bHABP, Cat#400763-1A, Associates of Cape Cod, Mass.) diluted 1:100 in HABP-buffer (0.25 M sodium phosphate buffer, pH 7.0, containing 1.5 M NaCl, 0.3 M guanidine-HCl, 0.08% BSA and 0.02% sodium azide, pH 7.0) was added to each slide. The slides were then incubated at 4° C. overnight. Next, the slides were rinsed in PBS-CMF and transferred to 0.6% $H_2O_2$ in methanol at room temperature. After rinsing in PBS-CMF, streptavidin-HRP (1 mg/mL, Cat# SA5004, Vector Laboratories, Inc., Burlingame, Calif.) was added to the sections, and developed with diaminobenzidine tetrahydrochloride (DAB, Cat# D3939, Sigma) and counterstained in Mayer's hematoxylin (Cat# S3309, Dako, Carpenteria, Calif.).

A total of 67 BPH and 19 normal prostate tissue samples were analyzed. In the sample set, the average age of the BPH and normal prostate tissue sample donors was 69.7±7.9 years and 36.7±5.4 years, respectively. The results for the HA staining of BPH tissue are shown in Table 4 below. HA expression was scored according to the following criteria:

High HA—Staining in Cells/Stromal Area (>70-80%) of Tissue Section
Moderate HA—Staining in >40% to 70% of Cells/Stromal Area of Tissue Section
Low HA—Staining in <40% of Cells/Stromal Area of Tissue Section
Negative HA—No observed staining In the stroma region, HA staining was moderate to high in 85% (57/67) of the BPH samples compared to 31.6% (6/19) in normal prostate samples. In the basal cells, 40% of the BPH samples were HA rich, as evidenced by high HA staining compared to 0% in normal prostate samples. Epithelial cell HA staining was negative in more than half (38/67) of the BPH samples.

TABLE 4

HA Score of Human BPH

|  | High | | Moderate | | Low | | Negative | |
| --- | --- | --- | --- | --- | --- | --- | --- | --- |
|  | BPH | Normal | BPH | Normal | BPH | Normal | BPH | Normal |
| Basal Cell | 27 (40%) | 0 | 33 (49%) | 1 (5.3%) | 6 (9%) | 8 (42.1%) | 1 (1.5%) | 10 (52.6%) |
| Stromal Cell | 18 (27%) | 0 | 30 (45%) | 1 (5.3%) | 16 (24%) | 11 (57.9%) | 3 (4%) | 7 (36.8%) |
| Stroma | 26 (39%) | 0 | 31 (46%) | 6 (31.6%) | 10 (15%) | 9 (47.4%) | 0 | 4 (21.1%) |
| Epithelial Cell | 1 (1.5%) | 0 | 14 (21%) | 0 | 14 (21%) | 0 | 38 (56.5%) | 0 |

Example 2

Rat Model of Testosterone Enanthate Induced Prostatic Hyperplasia

In this example, the ability of testosterone enanthate (TE) to induce prostatic hyperplasia in rat prostate was examined. Briefly, twenty-five (25) 8-week old male Sprague-Dawley rats (Harlan, USA) were dosed by intramuscular injection with 25 mg TE (Lot#80G010A, Abraxis Bioscience, Phoenix, Ariz.) per rat, once a week, on days 0, 7, 14 and 21. Five (5) out of 25 rats were sacrificed pre-TE treatment and 5 of the remaining 20 rats were sacrificed weekly. The ventral lobes of the prostates were harvested for analysis. Treatment with TE resulted in prostate growth, with an approximate 3-fold increase in size after treatment once a week for a month. Additionally, the increase in rat prostatic weight was linearly related to sustained TE exposure. The half-life of TE in the rat blood was approximately 10.5 days (Anderson R A, *J Clin Endocrinol Metab.*, (1996) 81(3):896-901).

Example 3

Effect of PEGPH20 on Normal Rat Prostate and TE-Induced Rat Prostatic Hyperplasia In this example, pegylated-PH20 (PEGPH20) was examined for its effect on normal rat prostate tissue and on TE-induced hyperplastic prostate tissue (rat BPH model described in Example 2 above).

A. Effect of PEGPH20 on Normal Rat Prostate

In this example, the effect of PEGPH20 on normal prostate tissue was examined. Five 8-week old male Sprague-Dawley rats (Harlan, USA) were dosed intravenously with PEGPH20 (diluted in normal saline) at 0.82 mg/kg every Mon, Wed and Fri for 2 weeks. Five (5) non-treated rats served as a control group. On day 12 post PEGPH20 treatment, the rats were sacrificed and the ventral lobes of the prostates were harvested for analysis. Prostate weight was measured using an electronic scale. Administration of PEGPH20 did not cause a significant change in prostatic weight of normal rat prostate as compared to treatment with vehicle alone (P =0.18).

B. Effect of PEGPH20 on Prostatic Stromal HA

In this example, the effect of PEGPH20 on prostatic stroma and stromal HA of normal and TE-induced prostatic hyperplasia rats was analyzed by prostatic histology, including hematoxylin and eosin staining and IHC staining. Stromal proliferation was determined by visually comparing the size of the stroma. Eight-week old male Sprague-Dawley rats were staged into 4 groups which were treated as indicated in Table 5 below. Testosterone enanthate was administered by intramuscular injection and PEGPH20 (diluted in normal saline) and control were administered intravenously. Following treatment, the animals were sacrificed and the ventral lobes of the prostates were harvested for analysis.

TABLE 5

Dosing regimen

| Group | # rats treated | TE Dose | TE Days | PEGPH20 Dose | PEGPH20 Days | Vehicle | Day sacrificed |
| --- | --- | --- | --- | --- | --- | --- | --- |
| 1 | 5 | — | — | — | — | None | 12 |
| 2 | 5 | — | — | 0.82 mg/kg | 12 | — | 12 |
| 3 | 4 | 25 mg/rat | 0 and 8 | — | — | Saline | 18 |
| 4 | 5 | 25 mg/rat | 0 and 8 | 0.82 mg/kg | 10 | — | 18 |

Prostate tissues were fixed in 10% neutral buffered formalin in PBS for 24 hours, dehydrated with gradient ethanol, cleared with xylene, and embedded in paraffin. Paraffin block was cut to 5 μm sections. Tissue sections were dewaxed, rehydrated and processed by standard hematoxylin and eosin (H&E) staining. Histochemical localization of HA was carried out using a biotinylated-HABP probe (bHABP, Cat#400763-1A, Associates of Cape Cod, Mass.). Sections were deparaffinized in xylene, 2×5 min, hydrated in 100% ethanol, for 2×3 min, and in 95% ethanol for 1 min, then rinsed in distilled water, incubated at 37° C. for 20 min in a trypsin solution, and rinsed in PBS for 2×2 min. Following incubation in 2% goat serum and 1% BSA in PBS for 30 min, sections were incubated with avidin and biotin block solution (Cat# MB-1220, Vector Laboratories, Inc., Burlingame, Calif.) and washed with PBS; sections were incubated with 4 μg/mL of bHABP in 1% BSA in PBS at 37° C. for 1 hour. After rinsing in 0.05% PBS-Tween 20 for 3×3 min, sections were incubated in FITC-streptavidin (Cat# CB4741954, Vector Laboratories, Inc., Burlingame, Calif., diluted 1:500 in PBS) at RT for 30 min, mounted in DAPI mounting medium (Cat# H-1200, Vector Laboratories, Inc., Burlingame, Calif.) and sealed with clear nail polish. Slides were observed blinded by an investigator under an Axioskop fluorescent microscope equipped with the appropriate filter. Micrographs of each section were taken with a camera scanner and SPOT advanced image program (DIAGNOSTIC Instrument, Inc.).

The results are set forth in Table 6 below. Treatment of normal prostate tissue with PEGPH20 degraded hyaluronic acid in the stroma. Treatment of normal prostate tissue with TE resulted in increased stromal proliferation as well as increased levels of HA in the stroma. Treatment with TE to induce prostatic hyperplasia followed by treatment with PEGPH20 resulted in decreased levels of hyaluronic acid in the stroma and decreased stromal proliferation such that the stroma was comparable in size to that of the control.

TABLE 6

Effects of PEGPH20, TE and TE + PEGPH20 on rat prostate stroma

| Group | Effect on HA | Effect on Stroma |
|---|---|---|
| 1 Control | None | None |
| 2 PEGPH20 | Completely degraded | None |
| 3 TE | Increased | Increased proliferation |
| 4 TE + PEGPH20 | Completely degraded | Decreased proliferation (compared to TE treated) |

C. Effect of PEGPH20 on Prostate Weight in TE-Induced Rat Prostatic Hyperplasia Model In this example, PEGPH20 was administered to TE-induced prostatic hyperplasic rats to evaluate its effect on prostate weight. Eight-week old male Sprague-Dawley rats were staged into 2 groups which were treated as indicated in Table 7 below. Testosterone enanthate was administered by intramuscular injection and PEGPH20 (diluted in normal saline) was administered intravenously. Following treatment, the animals were sacrificed and the ventral lobes of the prostates were harvested for analysis. Prostate weight was measured using an electronic scale.

TABLE 7

Dosing regimen

| Group | # rats treated | TE Dose | TE Days | PEGPH20 Dose | PEGPH20 Days | Day sacrificed |
|---|---|---|---|---|---|---|
| 1 | 5 | 25 mg/rat | 0 | — | — | 7 |
| 2 | 4 | 25 mg/rat | 0, 7 and 14 | Saline | | 18 |
| 3 | 5 | 25 mg/rat | 0 and 7 | 0.82 mg/kg | 7, 9, 11 | 12 |
| 4 | 5 | 25 mg/rat | 0, 7 and 14 | 0.82 mg/kg | 7, 9, 11, 13 | 14 |
| 5 | 5 | 25 mg/rat | 0, 7 and 14 | 0.82 mg/kg | 7, 9, 11, 13, 15 | 16 |
| 6 | 5 | 25 mg/rat | 0, 7 and 14 | 0.82 mg/kg | 7, 9, 11, 13, 15, 17 | 18 |
| 7 | 5 | — | — | 0.82 mg/kg | QOD, days 0-11 | 12 |
| 8 | 5 | — | — | Saline | | 12 |

QOD - administered every other day.

Prostate weight increased by 18.9% and 85.7% on day 7 and day 18, respectively, post TE exposure. Treatment of rats administered TE with PEGPH20, starting at day 7, inhibited the increase in prostatic weight by 26.5% (P<0.001). Additionally, the increase in prostate weight caused by TE was halted after approximately 5 days of the PEGPH20 dosing and with continued dosing no increase in prostate size was observed.

D. Evaluation of Duration of PEGPH20 Dosing

In this example, the effect of duration of treatment with PEGPH20 was evaluated by administering TE and PEGPH20 for different durations. TE was administered for either 2, 3 or 4 weeks and PEGPH20 was administered for either 1 week or 2 weeks.

Eight week old male rats were staged into 8 groups which were treated as indicated in Table 8 below. Testosterone enanthate was administered by intramuscular injection and PEGPH20 (diluted in normal saline) was administered intravenously. Following treatment, the animals were sacrificed and the ventral lobes of the prostates were harvested for analysis. Prostate weight was measured using an electronic scale.

TABLE 8

Dosing regimen

| Group | # rats treated | TE Dose | TE Days | PEGPH20 Dose | PEGPH20 Days | Day sacrificed |
|---|---|---|---|---|---|---|
| 1 | 4 | 25 mg/rat | 0, 7 | — | — | 28 |
| 2 | 8 | 25 mg/rat | 0, 7 | 0.82 mg/kg | QOD, days 7-20 | 21 |
| 3 | 4 | 25 mg/rat | 0, 7, 14, 21 | — | — | 28 |
| 4 | 8 | 25 mg/rat | 0, 7, 14, 21 | 0.82 mg/kg | QOD, days 7-20 | 28 |
| 5 | 4 | 25 mg/rat | 0, 7 | — | — | 21 |
| 6 | 8 | 25 mg/rat | 0, 7 | 0.82 mg/kg | QOD, days 7-20 | 21 |
| 7 | 4 | 25 mg/rat | 0, 7, 14 | — | — | 21 |
| 8 | 8 | 25 mg/rat | 0, 7, 14 | 0.82 mg/kg | QOD, days 7-20 | 21 |

QOD - administered every other day.

The results are set forth in Table 9 below. The results show that PEGPH20 treatment is both dosing and time dependent.

TABLE 9

Effects of various TE and PEGPH20 dosing regimens

| | 1 vs 2 | 3 vs 4 | 5 vs 6 | 7 vs 8 |
|---|---|---|---|---|
| Treatment | 2 wk TE, 1 wk PEGPH20, Sac Day 21 & 28 | 4 wk TE, 1 wk PEGPH20, Sac Day 28 | 2 wk TE, 2 wk PEGPH20, Sac Day 21 | 3 wk TE, 2 wk PEGPH20, Sac Day 21 |
| P value | 0.01 | 0.76 | <0.01 | 0.03 |
| % inhibition | 15.4 | 11.4 | 30 | 14.8 |
| Treatment term | Shorter TE, shorter PEGPH20, sac earlier | Longer TE, shorter PEGPH20, sac later | Shorter TE, longer PEGPH20, sac earlier | Longer TE, longer PEGPH20, sac earlier |

E. Evaluation of Time of First Administration

In this example, the time-dependence of treatment of rat BPH with PEGPH20 was evaluated by administering PEGPH20 at various time points. In short, 8-week old male Sprague-Dawley rats were staged into 8 groups which were treated as indicated in Table 10 below. Testosterone enanthate was administered by intramuscular injection and PEGPH20 (diluted in normal saline) was administered intravenously. Following treatment, the animals were sacrificed and the ventral lobes of the prostates were harvested for analysis. Prostate weight was measured using an electronic scale.

TABLE 10

Dosing regimen

| Group | # rats treated | TE Dose | TE Days | PEGPH20 Dose | PEGPH20 Days | Day sacrificed |
|---|---|---|---|---|---|---|
| 1 | 4 | 25 mg/rat | 0, 7 | — | — | 28 |
| 2 | 4 | 25 mg/rat | 0, 7, 14, 21 | — | — | 28 |
| 3 | 4 | 25 mg/rat | 0, 7 | — | — | 21 |
| 4 | 4 | 25 mg/rat | 0, 7, 14 | — | — | 21 |
| 5 | 8 | 25 mg/rat | 0, 7 | 0.82 mg/kg | QOD, days 7-14 | 21 |
| 6 | 8 | 25 mg/rat | 0, 7 | 0.82 mg/kg | QOD, days 7-20 | 21 |
| 7 | 8 | 25 mg/rat | 0, 7, 14, 21 | 0.82 mg/kg | QOD, days 7-14 | 28 |
| 8 | 8 | 25 mg/rat | 0, 7, 14 | 0.82 mg/kg | QOD, days 7-20 | 21 |

QOD - administered every other day.

The results are set forth in Table 11 below. Four weeks of induction of BPH with TE (group 2) resulted in the largest prostatic weight. In all groups, treatment with PEGPH20 reduced average prostatic weight as compared to treatment with TE alone. Co-administration of PEGPH20 with TE, starting at day 7, resulted in the largest decrease in average prostatic weight. Thus, better efficacy is observed with longer administration of PEGPH20.

Prostatic water weight was measured by weighing the prostate in a tube followed by snap-freezing in liquid nitrogen. The tubes were placed in a lyophilizer for 7 days and the prostate in the tube was weighed again after it was completely dried. Water content of the prostate was calculated from the wet weight and the dry weight. The prostatic water content of each group was found to be the same for all groups (~80%). Therefore, the change in prostate weight cannot be attributed to decreased tissue water.

TABLE 11

Effect of time of first admininstration

| Group | Prostatic Weight (g) Mean ± SD |
|---|---|
| 1 | 1.49 ± 0.47 |
| 2 | 1.76 ± 0.18 |
| 3 | 1.57 ± 0.09 |
| 4 | 1.54 ± 0.07 |
| 5 | 1.26 ± 0.14 |
| 6 | 1.10 ± 0.14 |
| 7 | 1.55 ± 0.12 |
| 8 | 1.31 ± 0.17 |

Example 4

Effects of PEGPH20 and Finasteride on TE-Induced Rat Prostatic Hyperplasia

In this example, the effects of treatment of TE-induced rat prostatic hyperplasia with PEGPH20 were compared to treatment with finasteride, an antiandrogen that is a 5α-reductase inhibitor that is used to treat BPH. Additionally, combination therapy with PEGPH20 and finasteride was evaluated.

A. Comparison of Treatment with PEGPH20 Versus Finasteride

In this example, the effect of treatment with PEGPH20 was compared to treatment with finasteride using the rat TE-prostatic hyperplasia model. Eight week old male rats were staged into 3 groups which were treated as indicated in Table 12 below. Testosterone enanthate was administered by intramuscular injection, PEGPH20 (diluted in normal saline) was administered intravenously and finasteride was administered intraperitoneally. On day 21 the animals were sacrificed and the ventral lobes of the prostates were harvested for analysis. Prostate weight was measured using an electronic scale.

TABLE 12

Dosing regimen

| Group | # rats treated | TE Dose | TE Days | PEGPH20 Dose | PEGPH20 Days | Finasteride Dose | Finasteride Days |
|---|---|---|---|---|---|---|---|
| 1 | 4 | 25 mg/rat | 0, 7 | — | — | — | — |
| 2 | 8 | 25 mg/rat | 0, 7 | 0.82 mg/kg | QOD, days 7-20 | — | — |
| 3 | 8 | 25 mg/rat | 0, 7 | — | — | 25 mg/kg | Daily, days 7-20 |

QOD, every other day.

The results show that administration of PEGPH20 results in approximately 30% inhibition of prostate growth, whereas treatment with finasteride results in approximately 37% inhibition of prostate growth. The decrease in prostatic weight of both treated groups, as compared to Group 1 which was treated with TE alone, is statistically significant (P<0.01 for both). The prostatic water content of each group was calculated from the wet weight and the dry weight and found to be the same for all groups (~80%). Therefore, the change in prostate weight cannot be attributed to decreased tissue water.

B. Co-Administration of PEGPH20 and Finasteride

In this example, the effect of combination therapy with PEGPH20 and finasteride was evaluated. PEGPH20 was administered at a dose of either 0.82 mg/kg (low dose) or 2 mg/kg (high dose). In short, 8-week old male Sprague-Dawley rats were staged into 6 groups which were treated as indicated in Table 13 below. Testosterone enanthate was administered by intramuscular injection, PEGPH20 (diluted in normal saline) was administered intravenously and finasteride was administered intraperitoneally. On day 21 the animals were sacrificed and the ventral lobes of the prostates were harvested for analysis. Prostate weight was measured using an electronic scale.

TABLE 13

Dosing regimen

| Group | # rats treated | TE Dose | TE Days | PEGPH20 Dose | PEGPH20 Days | Finasteride Dose | Finasteride Days |
|---|---|---|---|---|---|---|---|
| 1 | 8 | 25 mg/rat | 0, 7, 14 | — | — | — | — |
| 2 | 8 | 25 mg/rat | 0, 7, 14 | 0.82 mg/kg | QOD, starting on day 7 | — | — |
| 3 | 8 | 25 mg/rat | 0, 7, 14 | 2 mg/kg | QOD, starting on day 7 | — | — |
| 4 | 8 | 25 mg/rat | 0, 7, 14 | — | — | 25 mg/kg | Daily, starting on day 7 |
| 5 | 8 | 25 mg/rat | 0, 7, 14 | 0.82 mg/kg | QOD, starting on day 7 | 25 mg/kg | Daily, starting on day 7 |
| 6 | 8 | 25 mg/rat | 0, 7, 14 | 2 mg/kg | QOD, starting on day 7 | 25 mg/kg | Daily, starting on day 7 |

QOD, every other day.

The results are set forth in Table 14 below. Percent (%) inhibition was determined according to the formula: ((Control-treated)/Control)×100. Treatment with a low dose of PEGPH20, finasteride alone or combination therapy with a low dose of PEGPH20+ finasteride resulted in approximately 25% inhibition of prostate growth. Combination therapy of a high dose of PEGPH20 (2 mg/kg)+finasteride resulted in the largest inhibition of prostate growth (41%, P<0.001). The prostatic water content of each group was calculated from the wet weight and the dry weight and found to be the same for all groups (~80%). Therefore, the change in prostate weight cannot be attributed to decreased tissue water.

TABLE 14

Combination therapy with PEGPH20 and Finasteride

| | 1 | 2 | 3 | 4 | 5 | 6 |
|---|---|---|---|---|---|---|
| Treatment | 3 wk TE | 3 wk TE Lo PEGPH20 (2 wk) | 3 wk TE Hi PEGPH20 (2 wk) | 3 wk TE finasteride (2 wk) | 3 wk TE Lo PEGPH20 + finasteride (2 wk) | 3 wk TE Hi PEGPH20 + finasteride (2 wk) |
| Prostatic Weight (g) Mean ± SD | 1.33 ± 0.23 | 0.98 ± 0.17 | 1.08 ± 0.21 | 1.00 ± 0.19 | 0.99 ± 0.14 | 0.79 ± 0.17 |
| P value | NA | 0.003 | 0.038 | 0.007 | 0.003 | <0.001 |
| % Inhibit | NA | 26.6 | 19 | 25.2 | 25.9 | 41 |

Example 5

Apoptosis of Stromal Cells Following HA Removal in a TE-Induced Rat Prostatic Hyperplasia In this example, the ability of PEGPH20 to cause apoptosis of stromal cells was analyzed. In situ detection of cell apoptosis by TUNEL assay was based on a reaction for in situ terminal deoxynucleotidyl-transferase (TdT)-mediated biotinylated UTP nick-end labelling (TUNEL). This was essentially performed by using the FragEL DNA (Cat# QIA39-1EA, Calbiochem, Gibbstown, N.J.) according to the manufacturer's directions. In brief, de-paraffinized tissue sections were treated with proteinase K (0.02 mg/mL, Cat#25530, Invitrogen, Carlsbad, Calif.). The slides were then washed in Tris buffered saline (TBS), and endogenous peroxidase was blocked for 5 min in 3% $H_2O_2$ diluted in methanol. After washes in TBS, sections were treated with 1×TdT equilibration buffer at room temperature for 30 min and subsequently incubated with TdT labelling reaction mix (57 mL equilibration buffer plus 3 mL TdT enzyme) for 1.5 h at 37° C. The slides were rinsed in TBS and mounted using Fluorein-FragEL mounting media, then sealed with nail polish. The number of TUNEL-positive cells was counted on each section at ×200 under a light microscope.

The immunohistochemical staining revealed that the apoptosis was induced only in stromal cells. Table 15 below sets forth the treatment regimen, the mean number of apoptotic cells per section, and the P value, as compared to TE 7d plus TE 18d. PEGPH20 did not induce stromal apoptosis in non-testosterone treated prostate. PEGPH20 treatment of rats with TE-induced prostatic hyperplasia caused significant apoptosis in prostate stromal cells.

TABLE 15

Apoptosis of stromal cells

| Group | Apoptotic cells/section Mean ± SD | P value |
|---|---|---|
| Non-treated | 0 | NA |
| PEGPH20 12 d | 0.8 ± 1.79 | NA |
| TE 7 d | 4.6 ± 2.51 | NA |
| TE 18 d | 1.75 ± 1.71 | NA |
| TE 12 d, PEGPH20 5 d | 25.6 ± 20.16 | 0.006 |
| TE 14 d, PEGPH20 7 d | 36.8 ± 21.99 | 0.001 |

TABLE 15-continued

Apoptosis of stromal cells

| Group | Apoptotic cells/section Mean ± SD | P value |
|---|---|---|
| TE 16 d, PEGPH20 9 d | 13.4 ± 5.73 | 0.001 |
| TE 18 d, PEGPH20 1 d | 7.8 ± 2.71 | 0.010 |

Example 6

Effects of Depo-PH20 on TE-Induced Rat Prostatic Hyperplasia

In this example, Depo-PH20 was examined for its ability to treat TE-induced rat prostatic hyperplasia, as compared to treatment with PEGPH20. Depo-PH20 contains PH20 and a phospholipid gel in a fluid carrier.

Eight week old male Sprague-Dawley rats were staged into 5 groups which were treated as indicated in Table 16 below. Testosterone enanthate was administered by intramuscular injection, PEGPH20 was administered intravenously or by intra-prostatic injection and DepoGel vehicle or DepoPH20 were administered by intra-prostatic injection. On day 21 the animals were sacrificed and the ventral lobes of the prostates were harvested for analysis. Prostate weight was measured using an electronic scale.

TABLE 16

Dosing Regimen

| | | | | PEGPH20 | | | |
|---|---|---|---|---|---|---|---|
| Group | # rats treated | TE Dose | Days | iv | Intraprostatic injection (3.3 mg/mL) | DepoGel | DepoPH20 (0.095 mg/mL) |
| 1 | 10 | 25 mg/rat | 0, 7, 14 | — | — | — | — |
| 2 | 10 | 25 mg/rat | 0, 7, 14 | QOD, starting on day 7 | — | — | — |
| 3 | 10 | 25 mg/rat | 0, 7, 14 | — | 100 µL, days 7 and 14 | — | — |
| 4 | 10 | 25 mg/rat | 0, 7, 14 | — | — | 100 µL, day 7 | — |
| 5 | 10 | 25 mg/rat | 0, 7, 14 | — | — | — | 100 µL, day 7 |

QOD, every other day.

The results are set forth in Table 17 below. Treatment with PEGPH20, either intravenously or by intra-prostatic injection, resulted in a significantly smaller prostate, as evidenced by a reduction in prostatic weight. No significant difference in prostatic weight was observed between the groups treated with DepoGel (control) and Depo-PH20, and additionally, treatment with Depo-PH20 did not cause a significant reduction in prostatic weight, as compared to treatment with TE alone. The Depo-PH20 gel formulation that was administered was thick and visible white clumps were observed in the prostates of the rats treated with this formulation. These white clumps were also observed in the prostates of the rats treated with the Depo-Gel alone. Since the overall size and weight of a rat prostate is inherently small, the presence of these clumps may be contributing to the lack of effect observed for treatment with Depo-PH20.

TABLE 17

Effects of Depo-PH20 on TE-induced rat prostatic hyperplasia

| Group | Prostatic Weight Mean ± SD (g) | % inhibition | P value (vs ctl) | P value (DepoGel vs Depo-PH20) |
|---|---|---|---|---|
| TE 3 wks | 1.64 ± 0.12 | NA | NA | NA |
| TE 3 wks, DepoGel 2 wks | 1.55 ± 0.21 | 5.8 | 0.225 | NA |
| TE 3 wks, Depo-PH20 2 wks | 1.50 ± 0.24 | 8.7 | 0.107 | 0.64 |
| TE 3 wks, PEGPH20 IV 2 wks | 1.36 ± 0.16 | 17.3 | 0.0003 | NA |
| TE 3 wks, PEGPH20 intra-prostate 2 wks | 1.38 ± 0.17 | 16.0 | 0.0009 | NA |

Example 7

Multivesicular Liposome (MVL) PH20 Formulations

Various extended release multivesicular liposome PH20 (MVL-PH20) formulations were prepared using the following general procedure. The lipid solutions contained mixtures of various neutral lipids, including triglycerides (TG) triolein ($C_{18:1}$), tricaprylin ($C_{8:0}$) and cholesterol, and lipids with both positive and negative charges, including phosphatidylcholines (PC), dioleoylphosphatidylcholine (DOPC, $C_{18:1}$), dierucoyl phosphatidylcholine (DEPC, $C_{22:1}$) and dipalmitoyl phosphorylglycerol (DPPG, $C_{16:1}$). Total PC concentration was up to 19.8 mM, cholesterol concentration was 30 mM, TG concentration was up to 3.9 mM and DPPG concentration was 4.2 mM.

A. Generation of MVL-PH20 Formulations

MVL formulations containing varying mole percent of DEPC and DOPC (0-100%) and varying mole percent of triolein and tricaprylin (0-100%), DPPG, cholesterol, and 0.1, 0.25, 0.5, 1 or 2 mg/mL PH20 were prepared. Briefly, in the first step, the lipids in chloroform (oil phase) and PH20 in a first aqueous solution (water phase) were combined and emulsified to form a water-in-oil emulsion, whereby the PH20 was encapsulated by the phospholipid monolayer. In the second step, a second aqueous solution was added and emulsified, whereby a water-in-oil-in-water emulsion was formed. Subsequently, after addition of a second aliquot of the second aqueous solution, the chloroform solvent was evaporated and the resulting product containing multivesicular liposomes was washed multiple times in a third aqueous solution and resuspended to approximately 50% lipocrit (packed particle volume) and stored at 2-8° C.

Specifically, the formulations were prepared using either a mini vortex or were prepared on a larger scale using an Omni mixer (Omni Macro ES, Omni International, Kennesaw, Ga.). In the latter Omni mixer method, the lipid solution in chloroform (6 mL) was emulsified at 7,000 rpm for 8 min with an Omni Mixer with 6 mL of the first aqueous solution (10 mM His-HCl, pH 6.5 with 5% sucrose containing varying concentrations of PH20) producing a water-in-oil emulsion. A subsequent emulsification at 4500 rpm for 1-3 mM with 20 mL of a second aqueous solution of 3.2% glucose containing 40 mM lysine, pH 10.0, resulted in a water-in-oil-in-water second emulsion. The second emulsion was transferred equally into two Erlenmeyer flasks and another 50 mL aliquot of the second aqueous solution was added to both flasks. Chloroform was removed by flushing nitrogen over the surface of the emulsion at 35° C. The MVL particles containing PH20 were washed three times with 50 mL third aqueous solution (25 mM His-HCl buffer, pH 6.0 containing 120 mM NaCl) by adding the solution, mixing the centrifuge tube by inversion, and centrifugation at 3500 rpm for 10 mM at 4° C. in a refrigerated table top centrifuge. Finally, the MVL particles were resuspended in the third aqueous solution to form an approximately 50% lipocrit formulation and stored refrigerated at 2-8° C. The mini vortex procedure was similar, using the parameters set forth in Table 18.

Table 18 below summarizes the first, second and third aqueous solutions. Table 18 also summarizes the volumes, reagent concentrations and other parameters of each step of the MVL process.

TABLE 18

| MVL-PH20 formulation and process parameters | |
|---|---|
| 1st Aqueous Solution | 10 mM His-HCl, pH 6.5 with 5% sucrose |
| 2nd Aqueous Solution | 3.2% glucose containing 40 mM lysine, pH 10.0 |
| 3rd Aqueous Solution | 25 mM His-HCl buffer, pH 6.0 containing 120 mM NaCl |

| | Vortex Mixer | | Omni Mixer | | |
|---|---|---|---|---|---|
| $1^{st}$ Emulsion Mixing | | | | | |
| PH20 in 1st aqueous solution | 600 µL | | 6 mL | | |
| Lipid Solution in chloroform | 600 µL | | 6 mL | | |
| Total Volume | 1.2 mL | | 12 mL | | |
| $1^{st}$ Emulsification Speed | Maximum RPM | | 7000 RPM | | |
| Time | 8 min | | 8 min | | |
| Starting PH20 protein concentration (activity) | 0.25 mg/mL (30,000 U/mL) | 0.5 mg/mL (60,000 U/mL) | 0.5 mg/mL (60,000 U/mL) | 1.0 mg/mL (120,000 U/mL) | 2.0 mg/mL (240,000 U/mL) |
| PC | 15.8-19.8 mM | | 15.8-19.8 mM | | |
| Cholesterol | 30 mM | | 30 mM | | |
| TG | 3.75-3.9 mM | | 3.75-3.9 mM | | |
| DPPG | 4.2 mM | | 4.2 mM | | |
| Blade Type 1 | Not applicable | | Sharp on the sides | | |
| Blade Type 2 | Not applicable | | Sharp on the sides and on the inside | | |
| Blade Type 3 | Not applicable | | Flat all over, not sharp | | |
| $2^{nd}$ Emulsion Mixing | | | | | |
| 2nd Aqueous Solution | 2.5 mL | | 20 mL | | |
| Total Volume | 3.7 mL | | 32 mL | | |
| Speed | Maximum RPM | | 4500 RPM | | |
| Time | 15 sec | | 1-3 min | | |
| Solvent Evaporation | | | | | |
| 2nd Aqueous Solution | 10 mL | | 100 mL | | |
| Total Volume | 13.7 mL | | 132 mL | | |
| Shaking Water Bath Speed | 100-130 RPM | | 100-130 RPM | | |
| Time | 11 min | | 15 min | | |
| Temperature | 35° C. | | 35° C. | | |
| Washing, buffer exchange and resuspension | | | | | |
| Sample | Entire Sample | | 17 mL | | |
| 3rd Aqueous Solution | 50 mL | | 50 mL | | |
| Total Volume | 50 mL | | 200 mL | | |
| Centrifugation Speed | 3500 RPM | | 3500 RPM | | |
| Time | 10 min | | 10 min | | |
| Number of Washes | 3 | | 3 | | |
| Resuspension Volume | 0.3-0.5 mL | | 3-5 mL | | |
| LIPOCRIT | | | | | |
| Pellet volume | Varies | | Varies | | |
| 3rd Aqueous Solution | Varies | | Varies | | |
| Speed | 3500 rpm | | 3500 rpm | | |
| Time (min) | 10 min | | 10 min | | |
| Solution + Pellet Volume | Varies | | Varies | | |
| % Lipocrit Adjusted to | ~50% | | ~50% | | |

B. Summary of MVL-PH20 Formulations

Several MVL-PH20 formulations containing varying molar ratios of lipids, PH20 and other additives were prepared using the same general procedures as described above. The various additional additives were included in the $1^{st}$ aqueous solution to enhance and preserve the stability of encapsulated PH20. For example formulations F68 and F69 contained calcium chloride. Formulation F82 contained 150 µL glycerol as an interphase separating the 600 µL chloroform phase and 600 µL first aqueous solution phase. Formulation F83 contained 0.1% dextran 40,000 and 0.1% PEG-6000. Formulations F85-F87 contained hyaluronic acid (HA) oligomers. Several formulations varied in their mixing/emulsification procedures. For example, for formulation F66, the first emulsification step was carried out for 4 minutes, instead of 8 minutes, resulting in smaller liposomal pellets. Formulation F67 was mixed with a rotor wheel, instead of a mini vortex to generate lesser shear during mixing.

Table 19 below sets forth various MVL-PH20 formulations, including the formulation number, the formulation PC (phosphatidylcholine) and TG (triglyceride) molar % ratios, the starting concentration of PH20 in mg/mL, the mixer used for making the emulsions, and any additives that were included in the first aqueous solution.

TABLE 19

MVL Formulations with PH20

| Formu-lation | Formulation PC & TG mol % ratio | Starting PH20 concentration mg/mL | Mixer | Additives in First Aqueous Solution |
|---|---|---|---|---|
| F40 | DEPC with Triolein | 0.25 | Mini Vortex | N/A |
| F41 | DEPC with Triolein | 0 | Mini Vortex | N/A |
| F42 | DEPC with Triolein | 0.25 fluorescent labeled | Mini Vortex | AlexaFluor 488 labeled PH20 |
| F53 | 25/75 DEPC/DOPC; 25/75 Triolein/Tricap | 0.25 | Mini Vortex | N/A |
| F54 | 50/50 DEPC/DOPC; 50/50 Triolein/Tricap | 0.25 | Mini Vortex | N/A |
| F55 | 75/25 DEPC/DOPC; 75/25 Triolein/Tricap | 0.25 | Mini Vortex | N/A |
| F56 | 90/10 DEPC/DOPC; 90/10 Triolein/Tricap | 0.25 | Mini Vortex | N/A |
| F61 | 50/50 DEPC/DOPC; 50/50 Triolein/Tricap | 0.25 | Omni | N/A |
| F66 | 50/50 DEPC/DOPC; 50/50 Triolein/Tricap | 0.25 | Mini Vortex[1] | N/A |
| F67 | 50/50 DEPC/DOPC; 50/50 Triolein/Tricap | 0.25 | Rotor Wheel | N/A |
| F68 | 50/50 DEPC/DOPC; 50/50 Triolein/Tricap | 0.25 | Mini Vortex | 20 mM $CaCl_2$ |
| F69 | 50/50 DEPC/DOPC; 50/50 Triolein/Tricap | 0.25 | Mini Vortex | 10 mM $CaCl_2$ |
| F70 | 50/50 DEPC/DOPC; 50/50 Triolein/Tricap | 0.0 | Omni | N/A |
| F71 | 50/50 DEPC/DOPC; 50/50 Triolein/Tricap | 0.25 | Omni | N/A |
| F72 | 50/50 DEPC/DOPC; 50/50 Triolein/Tricap | 0.5 | Omni | N/A |
| F73 | 50/50 DEPC/DOPC; 50/50 Triolein/Tricap | 0.5 | Omni | N/A |
| F74 | 50/50 DEPC/DOPC; 50/50 Triolein/Tricap | 1.0 | Omni | N/A |
| F75 | 50/50 DEPC/DOPC; 50/50 Triolein/Tricap | 2.0 | Omni | N/A |
| F77[2] | 50/50 DEPC/DOPC; 50/50 Triolein/Tricap | 1.0 | Omni | |
| F78 | DEPC with Triolein | 1.0 | Omni | N/A |
| F79 | DEPC with Triolein | 1.0 | Omni | N/A |
| F80 | 50/50 DEPC/DOPC; 50/50 Triolein/Tricap | 1.0 | Omni | N/A |
| F81 | DEPC with Triolein | 0.5 | Omni | N/A |
| F82 | 50/50 DEPC/DOPC; 50/50 Triolein/Tricap | 0.5 | Mini Vortex | 150 µL Glycerol as interphase |
| F83 | 50/50 DEPC/DOPC; 50/50 Triolein/Tricap | 1.0 | Omni | 0.1% Dextran 40,000 0.1% PEG-6000 |
| F84 | 50/50 DEPC/DOPC; 50/50 Triolein/Tricap | 1.0 | Omni[3] | N/A |
| F85 | 50/50 DEPC/DOPC; 50/50 Triolein/Tricap | 1.0 | Omni | 15 mg/mL HA 74,000 |
| F85R1 | 50/50 DEPC/DOPC; 50/50 Triolein/Tricap | 1.0 | Omni | 15 mg/mL HA 74,000 |
| F86 | 50/50 DEPC/DOPC; 50/50 Triolein/Tricap | 1.0 | Omni | 50 mg/mL HA 74,000 |
| F87 | 50/50 DEPC/DOPC; 50/50 Triolein/Tricap | 1.0 | Omni | 100 mM Proline |
| F88 | 50/50 DEPC/DOPC; 50/50 Triolein/Tricap | 1.0 | Omni | 100 mM Arg-HCl, pH 6.44 |
| F89 | 50/50 DEPC/DOPC; 50/50 Triolein/Tricap | 1.0 | Omni | 6% Sorbitol |
| F90 | 50/50 DEPC/DOPC; 50/50 Triolein/Tricap | 1.0 | Omni | 6% Trehalose |

[1]Shorter first emulsion mixing time (4 min)
[2]Animal derived cholesterol used instead of plant derived cholesterol in the lipid solution
[3]Shorter first emulsion mixing time (4 min) and shorter second emulsion mixing time (30 sec)

Example 8

Multivesicular Liposome (MVL) Co-Formulations

Various multivesicular liposomes containing finasteride, dutasteride, or PH20 combination formulations were prepared using the following general procedure. The lipid solutions contained mixtures of various neutral lipids, including triglycerides (TG) triolein ($C_{18:1}$), tricaprylin ($C_{8:0}$) and cholesterol, and lipids with both positive and negative charges, including phosphatidylcholines (PC), dioleoylphosphatidylcholine (DOPC, $C_{18:1}$), dierucoyl phosphatidylcholine (DEPC, $C_{22:1}$) and dipalmitoyl phosphorylglycerol (DPPG, $C_{16:1}$). Total PC concentration was up to 19.8 mM, cholesterol concentration was 30 mM, TG concentration was up to 3.9 mM and DPPG concentration was 4.2 mM. In some formulations, the total concentration of all lipid components was increased, and in some others, the cholesterol content was decreased. Finasteride or dutasteride solutions were prepared in the lipid solution.

A. Generation of MVL-Finasteride, Dutasteride, or PH20 Combination Formulations

MVL formulations containing varying concentrations of finasteride, or dutasteride were prepared either containing no PH20, or with 0.1 mg/mL PH20 in the first aqueous solution. Briefly, in the first step, the finasteride or dutasteride and the lipids in chloroform (oil phase) and PH20 in a first aqueous solution (water phase) were combined and emulsified to form a water-in-oil emulsion, whereby the PH20 was encapsulated by the phospholipid monolayer, and the finasteride or dutasteride were incorporated into the lipid layer. In the second step, a second aqueous solution was added and emulsified, whereby a water-in-oil-in-water emulsion was formed. Subsequently, after addition of a second aliquot of the second aqueous solution, the chloroform solvent was evaporated and the resulting product containing multivesicular liposomes was washed multiple times in a third aqueous solution and resuspended to approximately 50% lipocrit (packed particle volume) and stored at 2-8° C.

Specifically, the formulations were prepared using a mini vortex. The mini vortex procedure was similar to that described under example 7 using the parameters set forth in Table 18, except that the volume of the first aqueous solution phase was 500 µL instead of 600 µL.

B. Summary of MVL-Finasteride, Dutasteride or PH20 Co-Formulations

Several MVL-finasteride, dutasteride, or PH20 containing combination formulations were prepared using the same general procedures as described above. Formulations with varying concentrations of finasteride or dutasteride were prepared. Varying lipid concentrations were also tested. For example formulations F3 and F4 contained lower concentration of cholesterol; 15 mM instead of 30 mM. Formulations F5, F6, and F7 contained higher concentrations of all the lipids. Table 20 below sets forth various MVL-finasteride, dutasteride, and PH20 combination formulations, including the formulation number, the lipid composition, and the starting concentrations of finasteride, dutasteride, or PH20 in mg/mL

TABLE 20

MVL formulations with finasteride, or dutasteride, or PH20, and combination

| Formulation | Lipid Composition | Finasteride concentration in lipid solution (mg/mL) | Dutasteride concentration in lipid solution (mg/mL) | PH20 concentration in first aqueous solution (mg/mL) |
|---|---|---|---|---|
| F1 | 19.8 mM DEPC, 3.9 mM Triolein, 4.2 mM DPPG, 30 mM cholesterol | 25 | NA | 0.1 |
| F2 | 19.8 mM DEPC, 3.9 mM Triolein, 4.2 mM DPPG, 30 mM cholesterol | 5 | NA | No PH20 |
| F3 | 19.8 mM DEPC, 3.9 mM Triolein, 4.2 mM DPPG, 15 mM cholesterol | 0 | NA | No PH20 |
| F4 | 19.8 mM DEPC, 3.9 mM Triolein, 4.2 mM DPPG, 15 mM cholesterol | 5 | NA | No PH20 |
| F5 | 52.8 mM DEPC, 10.4 mM Triolein, 11.2 mM DPPG, 80 mM cholesterol | 5 | NA | No PH20 |
| F6 | 52.8 mM DEPC, 10.4 mM Triolein, 11.2 mM DPPG, 80 mM cholesterol | 2.5 | NA | No PH20 |
| F7 | 52.8 mM DEPC, 10.4 mM Triolein, 11.2 mM DPPG, 80 mM cholesterol | 1.25 | NA | No PH20 |
| F12 | 19.8 mM DEPC, 3.9 mM Triolein, 4.2 mM DPPG, 30 mM cholesterol | 0.5 | NA | No PH20 |
| F13 | 19.8 mM DEPC, 3.9 mM Triolein, 4.2 mM DPPG, 30 mM cholesterol | 0.5 | NA | 0.1 |
| F18 | 19.8 mM DEPC, 3.9 mM Triolein, 4.2 mM DPPG, 30 mM cholesterol | 10 | NA | No PH20 |
| F19 | 19.8 mM DEPC, 3.9 mM Triolein, 4.2 mM DPPG, 30 mM cholesterol | 10 | NA | 0.1 |
| F20 | 19.8 mM DEPC, 3.9 mM Triolein, 4.2 mM DPPG, 30 mM cholesterol | 10 | NA | 0.1 |
| F21 | 19.8 mM DEPC, 3.9 mM Triolein, 4.2 mM DPPG, 30 mM cholesterol | 15 | NA | No PH20 |
| F22 | 19.8 mM DEPC, 3.9 mM Triolein, 4.2 mM DPPG, 30 mM cholesterol | 15 | NA | 0.1 |
| F23 | 19.8 mM DEPC, 3.9 mM Triolein, 4.2 mM DPPG, 30 mM cholesterol | 20 | NA | No PH20 |
| F24 | 19.8 mM DEPC, 3.9 mM Triolein, 4.2 mM DPPG, 30 mM cholesterol | 20 | NA | 0.1 |
| F25 | 19.8 mM DEPC, 3.9 mM Triolein, 4.2 mM DPPG, 30 mM cholesterol | NA | NA | 0.1 |
| F27 | 19.8 mM DEPC, 3.9 mM Triolein, 4.2 mM DPPG, 30 mM cholesterol | NA | 0.5 | No PH20 |
| F28 | 19.8 mM DEPC, 3.9 mM Triolein, 4.2 mM DPPG, 30 mM cholesterol | NA | 0.5 | 0.1 |
| F29 | 19.8 mM DEPC, 3.9 mM Triolein, 4.2 mM DPPG, 30 mM cholesterol | NA | 5 | No PH20 |
| F30 | 19.8 mM DEPC, 3.9 mM Triolein, 4.2 mM DPPG, 30 mM cholesterol | NA | 5 | 0.1 |

Example 9

Analytical Methods and Characterization of Formulations

In this example, various analytical test methods and procedures for characterization of the MVL-PH20 formulations and co-formulations are described. The test methods allow for determination of PH20 content, PH20 activity, and characterization of MVL particles, such as particle size, lipocrit, microscopic observation, and in vitro release of PH20.

A. PH20, Finasteride, and Dutasteride Content by Reverse Phase (RP) HPLC

In this example, PH20 content, including suspension concentration and percent free PH20 concentration, was determined by reverse phase HPLC. The HPLC column and method parameters are set forth in Table 21 below. Separation was performed using the HPLC gradient as set forth in Table 22 below.

TABLE 21

RP-HPLC Column and Method Parameters

| | |
|---|---|
| Column | Agilent Zorbax 300 SB-C18 (4.6 × 250 mm) column (Cat No. 880995-902) with 5 micron particle size and inline filter |
| Injection Volume | 50 μL |
| Detection λ | 210 nm and 280 nm |
| Flow Rate | 1.0 mL/min |
| Column Temperature | 40° C. ± 1° C. |
| Autosampler | Ambient |
| Solvent A | 100% water, 0.1% Trifluoroacetic Acid (TFA) |
| Solvent B | 100% acetonitrile, 0.1% TFA |
| Run Time | 60 min |
| PH20 standards | 0, 5, 10, 20, 40 and 80 μg/mL in 1% SDS in first aqueous buffer (10 mM His-HCl, pH 6.5 with 5% sucrose) |
| Finasteride or dutasteride standards | 0, 5, 10, 20, 40 and 80 μg/mL in 90% isopropanol/10% 2N HCl |

TABLE 22

HPLC Gradient

| Time (min) | % solvent A | % solvent B |
|---|---|---|
| 0-15 | 95 | 5 |
| 15-15.5 | 75 | 25 |
| 15.5-25.5 | 50 | 50 |
| 25.5-26 | 20 | 80 |
| 26-39 | 5 | 95 |
| 39-40 | 5 | 95 |
| 40-60 | 95 | 5 |
| 60 | 95 | 5 |

1. PH20 Total (Suspension) Concentration

PH20 suspension concentration is the concentration of PH20 in the MVL suspension. When the lipocrit is adjusted to 50%, the formulation concentration of PH20 is half of the drug loading. To determine the PH20 suspension concentration, the MVL formulation was brought to room temperature and re-suspended by gently rocking back-and-forth until the suspension was homogeneous, by placing on a Hemavet Blood-Mixer for 10 minutes at room temperature. 50 μL of the MVL suspension was added to 450 μL of 1% SDS in first aqueous buffer (10 mM His-HCl, pH 6.5 with 5% sucrose) in an Eppendorf microcentrifuge tube. The tube was vortexed thoroughly and subsequently allowed to sit for 10-15 min at room temperature. The extraction material was centrifuged at 14,000 rpm for 2 minutes and the supernatant was removed for RP-HPLC analysis, as described above. PH20 concentration was calculated against a standard curve as determined according to Table 20 above and reported as total concentration. Percent purity of the main peak, percent of oxidation peaks, clips and other degradants were also reported after subtracting out non-protein peaks from the chromatogram.

2. Percent Free PH20 Concentration

Percent free PH20 is the amount of un-encapsulated PH20 that is in the supernatant, expressed as a percentage of the total amount of PH20 in the formulation. To determine the percent free PH20 concentration, the MVL formulation was brought to room temperature and re-suspended by gently rocking back-and-forth until the suspension was homogeneous, by placing on a Hemavet Blood-Mixer for 10 minutes at room temperature. 0.5 mL of the MVL suspension was added to an Eppendorf microcentrifuge tube and centrifuged for 10 min at 3,000 rpm. 100 μL of supernatant was transferred to an HPLC vial insert, making sure not to disturb the liposome pellet. 100 μL of 2% SDS in first aqueous buffer was added into the insert and the contents were mixed thoroughly by pipetting and subsequently allowed to incubate for 10-15 min at room temperature. Samples were placed on an autosampler then analyzed by RP-HPLC at room temperature to avoid SDS precipitation at lower temperatures. PH20 concentration was calculated against a standard curve and used to calculate the % free PH20 using the following equation:

$$\% \text{ free PH20} = \frac{[\text{PH-20 in supernatent}] \times (100 - \text{lipocrit})}{[\text{Total PH-20}]}$$

B. Size Exclusion Chromatography-HPLC (SEC-HPLC)

In this example, SEC-HPLC was used to determine the relative amounts of high molecular weight protein (HMWP), i.e., covalently bound aggregates, of PH20 present in the sample. In brief, the MVL formulation was brought to room temperature and re-suspended by gently rocking back-and-forth until the suspension was homogeneous, by placing on a Hemavet Blood-Mixer for 10 minutes at room temperature. 50 μL of the MVL suspension was added to 450 μL of 1% octyl glucoside in first aqueous buffer (10 mM His-HCl, pH 6.5 with 5% sucrose) in an Eppendorf micro centrifuge tube and the tube was vortexed briefly. The samples were shaken at 600 rpm in a 30° C. incubator for 30 minutes. The extracted material was centrifuged for 2 min at 14,000 rpm and the supernatant was removed for SEC-HPLC analysis, according to the column and method parameters set forth in Table 23 below. Monomer peak concentration was calculated from the standard curve and the concentration was reported. If protein aggregates were detectable from the spectral analysis, after excluding the lipid micelle peaks, percent (%) aggregation was reported.

TABLE 23

SEC-HPLC Column and Method Parameters

| | |
|---|---|
| Column | SEC TSK G3000 SWXL column with 5 micron particle size with column dimensions (7.8 mm × 300 mm) with an inline filter |
| Injection Volume | 100 μL |
| Detection λ | 210 and 280 nm |
| Flow Rate | 1.0 mL/min |
| Run Time | 24 min |
| Column Temperature | Ambient |
| Autosampler | Ambient |

TABLE 23-continued

SEC-HPLC Column and Method Parameters

| | |
|---|---|
| Mobile Phase (Isocratic) | Solvent A: 300 mM sodium phosphate buffer pH 7.4 (300 mM $Na_2HPO_4$ adjusted to pH 7.4 with phosphoric acid) |
| Gel Filtration Standards | Mixture of protein standards from 1.2 kDa to 660 kDa from Bio-Rad or equivalent |
| First aqueous buffer | 10 mM His-HCl, pH 6.5 with 5% sucrose |
| PH20 standards | 0, 5, 10, 20, 40 and 80 µg/mL in 1% octyl glucoside in first aqueous buffer |

C. Particle Characterization

1. Particle Size Analysis

Particle size distribution, or mean diameter of the distribution, is the volume-weighted size distribution of the MVL particle diameters, as measured by a Laser Diffraction Particle Size Analyzer. The mean diameter of the MVL particles in suspension is measured using a Horiba LA-910 laser Scattering Particle Size Distribution Analyzer. Briefly, the MVL formulation is resuspended on a Hemavet Blood-Mixer for 10 min at room temperature. Ten (10) mL normal saline is added to a 12 mL capacity quartz cell, followed by the addition of approximately 10 µL of the MVL suspension. The contents of the cuvette are mixed thoroughly and the particle size is measured.

2. Lipocrit (Packed Particle Volume, PPV)

Lipocrit is the percent of the packed particle volume of a MVL suspension. Lipocrits were determined by adding 70 µl., of MVL suspension to Micro-Hematocrit capillary tube, stoppering one end using Crit-O-Seal, or similar sealing putty, and centrifuging the tubes for 10 min at 600 g. After spinning, the supernatant and pellet lengths were measured. The lipocrit was calculated by taking the quotient of the pellet length to the combined supernatant/pellet length×100 to give the % PPV or % Lipocrit. Target lipocrit is 50%.

3. Microscopic Observation of MVL Particles

MVL particles were observed using phase contrast microscopy. Briefly, the MVL suspension was resuspended thoroughly and a 50 µL aliquot was added into an Eppendorf tube containing 50-200 µL normal saline. The sample was mixed by gently inverting the tube and 10 µL was transferred to a microscope slide. A cover slip was gently placed over the MVL sample and the sample was examined under a microscope using 10×, 20× and 40× magnification. Images were recorded with a digital camera attached to the microscope.

MVL formulations were characterized by light microscopy or fluorescent microscopy.

D. PH20 Enzymatic Activity

1. Biotinylated HA Enzymatic Activity Assay

PH20 activity was evaluated using a rapid biotinylated HA enzymatic assay, in which enzymatic activity was measured using a microtiter assay in which residual biotinylated hyaluronic acid is measured following incubation with hyaluronidase (see e.g. Frost and Stern (1997) Anal. Biochem. 251:263-269, U.S. Patent Publication No. 20050260186). In such assays, the free carboxyl groups on the glucuronic acid residues of hyaluronic acid were biotinylated, and the biotinylated hyaluronic acid substrate was covalently coupled to a microtiter plate. Following incubation with hyaluronidase, the residual biotinylated hyaluronic acid substrate was detected using an avidin-peroxidase reaction, and compared to that obtained following reaction with hyaluronidase standards of known activity.

2. Total (Suspension) PH20 Activity

Total PH20 activity is a measure of the activity of the PH20 that is inside and outside the liposome. In brief, the MVL formulation was brought to room temperature and re-suspended by gently rocking back-and-forth until the suspension was homogeneous, by placing on a Hemavet Blood-Mixer for 10 minutes at room temperature. 50 µL of the MVL suspension was added to 450 µL of 10% octyl glucoside in first aqueous buffer (10 mM His-HCl, pH 6.5 with 5% sucrose) in an Eppendorf microcentrifuge tube and the tube was vortexed briefly. The samples were shaken at 600 rpm in a 30° C. incubator for 30-90 minutes or overnight at 4° C. The extracted material was centrifuged for 2 min at 14,000 rpm. Samples were removed, diluted in assay buffer containing 1% octyl glucoside and loaded on a microtiter plate. PH20 enzymatic activity was determined using a rapid biotinylated HA hydrolysis assay (see Example D.1). Activity was reported in U/mL. Specific activity was calculated according to the following equation:

$$\text{Specific activity} = \frac{\text{Activity in U/mL}}{\text{Total protein concentration in suspension from (RP-HPLC)}}$$

3. Percent Free PH20 Activity

Percent free PH20 activity is a measure of the PH20 activity that is outside the liposome due to leakage/residual PH20 during the MVL-PH20 preparation. The MVL formulation was brought to room temperature and re-suspended by gently rocking back-and-forth until the suspension was homogeneous, by placing on a Hemavet Blood-Mixer for 10 minutes at room temperature. 0.5 mL of the MVL suspension was added to an Eppendorf microcentrifuge tube and centrifuged for 10 min at 3,000 rpm. 100 µL of supernatant was transferred to an HPLC vial insert, making sure not to disturb the liposome pellet. 100 µL of 2% SDS in first aqueous buffer was added into the insert and the contents were mixed thoroughly by pipetting and subsequently allowed to sit for 10-15 min at room temperature. PH20 activity was determined as described in Example D.1 above.

E. Summary of Characterization of Various MVL-PH20 Preparations

1. MVL-PH20 Formulations

Several MVL-PH20 formulations were generated and were analyzed using the test methods described above. The results of some of the prepared formulations are summarized in Tables 24-27 below. Prior to use, each formulation that was generated was characterized as described above. For example, MVL-PH20 formulations prepared with the Omni mixer also were evaluated as described above. These formulations exhibited good encapsulation, a specific activity for PH20 of 31,000 to 55,000 U/mg in total lysate. The total lysate PH20 activity was further enhanced, with increased extraction times (60-90 min) with octyl glucoside, to the range of 71,000 to 90,000 U/mg. Free PH20, leaked from the liposome, exhibited a specific activity of >100,000 U/mg.

Table 26 below sets forth the PH20 content and activity in supernatant fractions of the MVL-PH20 formulations. The total lysate (suspension) PH20 content and activity of the MVL-PH20 formulations, following increased extraction time with octyl glucoside, are set forth in Table 27. Furthermore, the integrity of the PH20 was preserved during the manufacturing process, with >90% purity of the main PH20 peak from RP-HPLC analysis.

TABLE 24

Characterization of Various MVL-PH20 Preparations

| | Formulation | | | | | |
|---|---|---|---|---|---|---|
| | F40 | F53 | F54 | F55 | F56 | F61 |
| Volume (mL) | 3.75 | 1.9 | 1.9 | 1.3 | 1.5 | 10 |
| Lipocrit % | 50 | 44 | 45 | 47 | 44 | 50 |
| Total (Suspension) PH20 concentration (mg/mL) | 0.18 | 0.13 | 0.14 | 0.14 | 0.13 | 0.13 |
| Packed Particle PH20 concentration (mg/mL) | 0.36 | 0.3 | 0.31 | 0.3 | 0.3 | 0.26 |
| Encapsulation Efficiency | 64 | 40 | 44 | 30 | 32 | 87 |
| Total (Suspension) PH20 Activity U/mL | 3520 | 6560 | 6477 | 6587 | 5927 | 2572 |
| RP-HPLC mg/mL (10% OG extraction) | ND | ND | ND | ND | ND | 0.09 |
| % Activity Recovery | 17 | 42 | 39 | 39 | 38 | 17 |

TABLE 25

Analysis of MVL Formulations

| Form. | % Liprocrit | Volume (mL) | Microscopy | Total (Suspension) PH20 Activity (U/mL) | [Total (Suspension) Protein] (mg/mL) | Total (Suspension) Specific Activity (U/mg) |
|---|---|---|---|---|---|---|
| F70 | NA | NA | Liposome formed | NA | NA | NA |
| F71 | 51 | 4 | Liposome formed | 1071 | 0.11 | 9739 |
| F72 | 45 | 4.2 | Liposome formed | 2151 | 0.23 | 9352 |
| F73 | 50 | 4 | Liposome formed | 1176 | 0.24 | 4900 |
| F74 | 48.8 | 5 | Liposome formed | 10293 | 0.33 | 31191 |
| F75 | 40 | 3.5 | Liposome formed | 6292 | 0.29 | 21697 |
| F77 | 42 | 4 | Liposome formed | 4993 | 0.26 | 19202 |
| F78 | 46 | 4 | Liposome formed | 2981 | 0.32 | 9316 |
| F79 | 40 | 4 | Liposome formed, lots of foaming after $2^{nd}$ emulsion | 938 | ND | NA |
| F80 | 40 | 4 | Liposome formed, lots of foaming after $2^{nd}$ emulsion | 930 | ND | NA |
| F81 | 41 | 4 | Liposome formed | 1375 | 0.23 | 5978 |
| F82 | 45 | 0.5 | Liposome formed | 1546 | 0.1 | 15459 |
| F83 | 54.237 | 5 | Liposome formed | 4077 | 0.46 | 8863 |
| F84 | NA | 200 μL | Very small pellet | ND | ND | NA |
| F85 | 55 | 8 | Liposome formed | 16116 | 0.363 | 44397 |
| F86 | 51 | 7.5 | Liposome formed | 13182.67 | 0.238 | 55389 |
| F87 | 54 | 5.5 | Liposome formed | 8346.75 | 0.283 | 29494 |
| F88 | 46 | 9.2 | Liposome formed | 14544 | 0.256 | 56813 |
| F89 | 45 | 4.9 | Liposome formed | ND | ND | ND |
| F90 | 50 | 5.95 | Liposome formed | ND | ND | ND |

NA: Not Applicable
ND: Not Determined

TABLE 26

Analysis of supernatant PH20 in MVL Formulations

| Form. | Activity Supernatant (U/mL) | RP-HPLC Supernatant (mg/mL) | Specific Activity Supernatant (U/mg) | % Free PH20 |
|---|---|---|---|---|
| F85 | 3246 | NA | NA | NA |
| F85R1 | 3678 | 0.073 | 50384 | 9.21 |
| F86 | 2829 | 0.057 | 49632 | 11.74 |
| F87 | 2617.5 | 0.059 | 44364 | 9.59 |
| F88 | 5680.67 | 0.092 | 61746 | 19.41 |

TABLE 27

Enhanced activity of PH20 in MVL after increased extraction times (60-90 min at room temperature) with octyl glucoside

| Form. | [Total (Suspension) PH20] (mg/mL) | Total (Suspension) PH20 Activity (U/mL) | Specific Activity (U/mg) |
|---|---|---|---|
| F74 | 0.33 | 23439 | 71027 |
| F85 | 0.36 | 32058 | 88314 |
| F88 | 0.26 | 23091 | 90199 |

2. MVL-PH20 Co-Formulations

Several MVL-finasteride, dutasteride, or combination formulations also containing PH20 were generated and analyzed using the test methods described above. The results show that at higher concentration of finasteride or dutasteride (5-25 mg/mL), microtubular structures were observed in addition to the characteristic MVL particles. The relative distribution of the microtubular structures was higher with increasing concentration of finasteride or dutasteride. Particles with overall better morphology in terms of rounded smooth structures were formed at 5 mg/mL drug concentration using 30 mM cholesterol; whereas formulations using 15 mM cholesterol resulted in poor particle formation at this drug concentration. At lower concentrations of finasteride or dutasteride (0.5-5 mg/ml), or using increased total lipid concentration, much better particle morphology characteristic of MVL structure, and increased drug incorporation efficiency was observed. Table 28 describes characteristics of some of the formulations. The total (suspension) PH20 activity extracted from formulations containing PH20, set forth in Table 28, was <150 U/mL.

TABLE 28

Analysis of MVL finasteride and dutasteride formulations

| Formulation Description | Starting Finasteride/Dutasteride concentration mg/mL | Total (Suspension) Finasteride or Dutasteride concentration mg/mL |
|---|---|---|
| F13 low finasteride | 0.5 | 0.12 |
| F24 high finasteride | 20 | 8.5 |
| F27 low dutasteride | 0.5 | 0.19 |
| F29 high dutasteride | 5 | 4.3 |

Example 10

Effect of PH20 Concentration in 1st Aqueous Phase on MVL-PH20 Attributes

Formulations F71-F75 containing starting PH20 amounts of 0.25, 0.5, 1 and 2 mg/mL were generated as described in Example 7 and compared for PH20 enzymatic activity, PH20 content and total volume yield using methods as described in Example 9 in order to determine the effect of the starting PH20 concentration on these attributes. The results show that as the starting PH20 amount increased, activity in U/mL and specific activity in U/mg both increased with a five-fold and three-fold increase in activity and specific activity, respectively, in formulations containing 1 mg/mL starting PH20. The activity and specific activity declined slightly in formulations containing 2 mg/mL starting PH20. Overall protein concentration increased for all formulations whereas total volume yield in mL was approximately the same for all formulations.

Example 11

In Vitro Protein Release in Buffer or Rat Plasma

MVL-PH20 formulations were evaluated for their PH20 release over time in buffer or rat plasma. Briefly, a 500 μL aliquot of the MVL-PH20 formulation was added to 2 mL of either rat plasma containing 0.01% sodium azide or third aqueous buffer and mixed thoroughly. The mixture was subjected to 12 cycle rotation on a shaker at 37° C. 2.5 mL aliquots were removed at days 0, 1, 3, 5 and 7 for analysis. 200 μL of each aliquot was analyzed by light microscopy. 2 mL of each aliquot was added to 2 mL saline, transferred to a 15 mL tube and centrifuged at 3500 rpm for 10 minutes. The supernatant was removed and its PH20 activity was determined in the presence of 1% octyl glucoside, as described in Example 9, section D above. The pellet was washed in saline, centrifuged, and 1000 μL 1% SDS was added. PH20 content was determined by HPLC.

The results show that over time, a decrease in the percentage of PH20 in the liposome pellet was observed, which plateaued after day 5. For example, in buffer, in vitro protein release was approximately 90% of day 0 protein content at day 1, approximately 75% of day 0 protein content at day 3 and approximately 60% of day 0 protein content at day 5. The percentage of PH20 in the liposome pellet did not decrease any further at day 7 but remained steady. In rat plasma, in vitro protein release was approximately 90% of day 0 protein content at day 1, approximately 80% of day 0 protein content at day 3, approximately 65% of day 0 protein content at day 5, which also remained steady at day 7.

The results also showed that the PH20 activity released into the medium was higher in rat plasma than in the third aqueous buffer. For each, there was an initial increase in activity observed in the medium at day 1 with almost 200% activity relative to day 0 rat plasma and approximately 150% activity relative to day 0 buffer. The activity plateaued after day 1 with a slight decrease out to day 7.

Example 12

Effect of MVL-PH20 Formulations on TE-Induced Hyperplastic Prostate Tissue

In this example, various MVL-PH20 formulations were evaluated for their effect on TE-induced hyperplastic prostate tissue using the rat BPH model described in Example 2 above.

A. Histological Analysis

1. Characterization of MVL-PH20 Formulations Used

Prior to the experiments performed in this example, the formulations were characterized as described above in Example 8. Each of the PH20-containing formulation contained an initial starting amount of 0.25 mg/mL PH20. The results are set forth in Table 29 below. The MVL-PH20$_{F40}$ and vehicle control formulations also were analyzed by light microscopy. The results showed the PH20 encapsulated in the liposomes. The AlexaFluor 488-PH20 formulation was analyzed by light microscopy and fluorescence microscopy. The results showed the AlexaFluor 488 labeled PH20 was encapsulated in the liposomes.

TABLE 29

Characterization of MVL-PH20 Preparations

| Formulation | Volume (mL) | Lipocrit % | Encapsulation (mg/mL) | Activity (U/mL) | % Activity Recovery |
|---|---|---|---|---|---|
| MVL-PH20$_{F40}$ | 3.75 | 50 | 0.15 | 3500-5200 | 30 |
| F41 Vehicle Control | 3.75 | 47 | 0 | <LLOQ | N/A |
| Alexa488-PH20$_{F42}$ | 3.0 | 50 | 0.15 | 1000 | 30 |

LLOQ: Lower limit of quantification

2. Summary of Histological Analysis of Treated Prostate

Rats were dosed with TE with and without MVL-PH20 similar to Example 3.B, except that MVL-PH20 was administered by intraprostatic injection. Prostate tissue collection, fixation and histology for HA localization also was performed as described in Example 3.B.

The results show that most HA was degraded following administration of MVL-PH20$_{F40}$ by intraprostatic injection on day 1 and HA was degraded partially in the area close to MVL-PH20$_{F40}$ administration on day 3. HA was not degraded on days 5, 7 and 10. Rats dosed with Alexa488-PH20$_{F42}$ were observed to contain a large percentage of fluorescent PH20 that remained at the injection site suggesting an initial period of release followed by very little release. This was expected due to the very slow releasing lipid components that stabilized the membrane of this formulation.

B. Treatment with MVL-PH20$_{F40}$

In a separate study, MVL-H20$_{F40}$ was tested for its effect on TE-induced Hyperplastic Prostate Tissue.

1. Characterization of MVL Formulations

Each MVL-PH20 formulation tested contained an initial starting amount of 0.25 mg/mL PH20 and were characterized as described in Example 9, with the results set forth in Table 30 below.

TABLE 30

Characterization of MVL-PH20 Preparations

| Formulation | Volume (mL) | Lipocrit % | Encapsulation (mg/mL) | Activity (U/mL) | % Activity Recovery |
|---|---|---|---|---|---|
| MVL-PH20$_{F40}$ | 3 | 50 | 0.17 | 5098 | 24 |
| F41 Vehicle Control | 2.5 | 52 | 0 | <LLOQ | N/A |

LLOQ: Lower limit of quantification

2. Analysis of Treated Prostate Tissue

In this study, 25 mg TE was administered intravenously to each rat on days 1 and 7. 50 µL of 4700 U/mL (0.18 mg/mL) MVL-PH20$_{F40}$ and 50 µL MVL-Vehicle were administered intraprostatically on day 7. Rats were sacrificed on day 9 to analyze prostate [HA], days 8, 10 and 14 to analyze apoptosis and day 14 to analyze prostate weight.

The results show that 1 and 3 days post MVL-PH20$_{F40}$ administration, HA adjacent to the MVL was removed. 7 Days post treatment, HA was present. Thus, a reduction in prostate HA was observed up to 3 days after treatment. Apoptosis of stromal cells was analyzed on days 8, 10 and 14. No difference was observed in apoptosis levels between vehicle treated and MVL-PH20$_{F40}$ treated prostate at day 1 post-administration. At day 3 post administration, increased apoptosis was observed in MVL-PH20$_{F40}$ treated prostate. At day 7 post administration, no PH20 induced apoptosis was observed in MVL-PH20$_{F40}$ treated prostate. The effect of treatment with MVL-PH20$_{F40}$ on prostatic weight is shown in Table 31 below. For comparison purposes, normal rat prostate weighs approximately 0.6 g. Treatment with MVL-PH20$_{F40}$ resulted in a significant decrease in prostate size as compared to treatment with MVL-vehicle control.

TABLE 31

Comparison of prostatic weight on Day 14

|  | Prostatic Weight (g) Mean ± SD | P-value | % Reduction relative to vehicle control |
|---|---|---|---|
| MVL-Vehicle Control | 1.298 ± 0.125 | n/a | n/a |
| MVL-PH20$_{F40}$ | 1.035 ± 0.079 | <0.0001 | 20.2 |
| Normal Prostate | 0.6 g | n/a | n/a |

C. Treatment with MVL-PH20 Formulations

MVL-PH20 formulations were tested for their effect on TE-induced Hyperplastic Prostate Tissue.

1. Characterization of MVL-PH20 Formulations

Each MVL-PH20 formulation tested contained an initial starting amount of 0.25 mg/mL PH20 in the $1^{st}$ aqueous solution and were characterized as described in Example 9, with the results set forth in Table 32 below.

TABLE 32

Characterization of MVL-PH20 Preparations

| Formulation | Volume (mL) | Lipocrit % | Encapsulation (mg/mL) | PH20 Activity (U/mL) | % Activity Recovery |
|---|---|---|---|---|---|
| 53 | 1.9 | 44 | 0.13 | 6560 | 42 |
| 54 | 1.9 | 45 | 0.14 | 6477 | 39 |
| 55 | 1.3 | 47 | 0.14 | 6587 | 39 |
| 56 | 1.5 | 44 | 0.13 | 5927 | 38 |

2. Analysis of Treated Prostate Tissue

In this study, 25 mg TE was administered intravenously to each rat on days 1 and 7. 50 µL MVL-PH20$_{FX}$ was administered intraprostatically to the right lobe of the prostate and 50 µL MVL-Vehicle$_{FX}$ administered intraprostatically to left lobe of the same rat prostate. The notation FX refers to the specific formulation that was assessed such as F53, F54, F55 or F56. Rats were sacrificed on Day 14 and analyzed for prostate weight and histology.

The data are shown in Table 33 below, which sets forth the formulation, activity and approximate % reduction in prostate weight relative to treatment with the vehicle. Treatment will all formulations caused a reduction in prostate size. Treatment with formulation F54 led to a 45% reduction in prostate size.

TABLE 33

TE-Induced Prostate Hyperplasia Reduction

| Formulation | PH20 Activity (U/mL) | Approximate % Reduction (relative to vehicle) |
|---|---|---|
| F53 | 6560 | 16 |
| F54 | 6477 | 45 |

TABLE 33-continued

TE-Induced Prostate Hyperplasia Reduction

| Formulation | PH20 Activity (U/mL) | Approximate % Reduction (relative to vehicle) |
|---|---|---|
| F55 | 6587 | 9 |
| F56 | 5927 | 8 |

D. Treatment with MVL-PH20$_{F40}$ and MVL-PH20$_{F54}$ and Finasteride

1. Characterization of MVL-PH20 Formulations

Each MVL-PH20 formulation contained an initial starting amount of 0.25 mg/mL PH20 in the 1$^{st}$ aqueous solution and were characterized as described in Example 9, with the results set forth in Table 34 below. MVL-PH20$_{F40}$ is predicted to have a slow PH20 release rate and MVL-PH20$_{F54}$ is predicted to have a medium PH20 release rate based on fatty acid chain length of the PC and TG composition.

TABLE 34

Characterization of MVL-PH20 Preparations

| Formulation | Volume (mL) | Lipocrit % | Encapsulation (mg/mL) | PH20 Activity (U/mL) | % Activity Recovery |
|---|---|---|---|---|---|
| MVL-PH20$_{F40}$ | 4 | 50 | 0.19 | 1320 | <10 |
| Vehicle Control | 4 | 47 | 0 | <LLOQ | N/A |
| MVL-PH20$_{F54}$ | 3 | 50 | 0.23 | 3057 | 12 |

2. Analysis of Treated Prostate Tissue

In this study, 25 mg TE was administered intravenously to each rat on days 1 and 7. 50 µL MVL-PH20$_{F40}$ or MVL-PH20$_{F54}$ were administered intraprostatically to each rat on day 7. 2.5 mg/kg Finasteride was administered by intraperitoneal injection to each rat daily, starting on day 7. The study design is set forth in Table 35 below.

TABLE 35

Study Design

| Group | TE 25 mg/rat/wk | MVL-PH20 I-Pr day 7 | Finasteride 2.5 mg/kg ip daily | Day to sac | n |
|---|---|---|---|---|---|
| 1 | Day 0, 7 | — | — | 14 | 12 |
| 2 | Day 0, 7 | — | Days 7-13 | 14 | 12 |
| 3 | Day 0, 7 | F40, day 7 | — | 14 | 12 |
| 4 | Day 0, 7 | F54, day 7 | — | 14 | 12 |
| 5 | Day 0, 7 | F40, day 7 | Days 7-13 | 14 | 12 |
| 6 | Day 0, 7 | F54, day 7 | Days 7-13 | 14 | 10 |

I-Pr: intraprostatically

The results are shown in Table 36 below. Treatment with finasteride led to a 18.7% reduction in prostate size relative to vehicle control. Treatment with either MVL-PH20 formulation resulted in 10-12% reduction in prostate size. Co-treatment with a MVL-PH20 formulation and finasteride resulted in 19-20% reduction in prostate size. The PH20 enzymatic activity of the MVL-PH20 used in this study were low, 1320 and 3057 U/mL respectively.

TABLE 36

Comparison of prostatic weight on Day 14

| | Prostatic Weight (g) Mean ± SD | P-value | % Reduction (relative to vehicle control) |
|---|---|---|---|
| Vehicle | 1.108 ± 0.090 | | |
| Vehicle + Finasteride | 0.901 ± 0.096 | <0.0001 | 18.7 |
| MVL-PH20$_{F40}$ | 0.996 ± 0.146 | 0.034 | 10.1 |
| MVL-PH20$_{F54}$ | 0.972 ± 0.112 | 0.0033 | 12.3 |
| MVL-PH20$_{F40}$ + Finasteride | 0.897 ± 0.138 | 0.0002 | 19.0 |
| MVL-PH20$_{F54}$ + Finasteride | 0.882 ± 0.083 | 0.0001 | 20.4 |

Since modifications will be apparent to those of skill in this art, it is intended that this invention be limited only by the scope of the appended claims.

SEQUENCE LISTING (189 sequences)

SEQ ID NO: 1 - protein, 509 aa, Homo sapiens
  precursor human PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  Mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor soluble rHuPH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  soluble rHuPH20 1-446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  soluble rHuPH20 1-445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  soluble rHuPH20 1-444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  soluble rHuPH20 1-443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  soluble rHuPH20 1-442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  hyalurinidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  hyaluronidase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes bacteriophage H4489A
  hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  sHuPH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  sHuPH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  sHuPH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  sHuPH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  sHuPH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  sHuPH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  sHuPH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  sHuPH20 mature 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  sHuPH20 mature 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble rHuPH20 "precursor"
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  Gen2 mRNA sequence
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble rHuPH20 aa 431-447
DAFKLPPMETEEPQIFY

SEQ ID NO: 58 - protein, 16 aa, Homo sapiens
  C-terminal peptide cleaved from soluble rHuPH20 aa 431-446
DAFKLPPMETEEPQIF

SEQ ID NO: 59 - protein, 15 aa, Homo sapiens
  C-terminal peptide cleaved from soluble rHuPH20 aa 431-445
DAFKLPPMETEEPQI

SEQ ID NO: 60 - protein, 14 aa, Homo sapiens
  C-terminal peptide cleaved from soluble rHuPH20 aa 431-444
DAFKLPPMETEEPQ

SEQ ID NO: 61 - protein, 13 aa, Homo sapiens
  C-terminal peptide cleaved from soluble rHuPH20 aa 431-443
DAFKLPPMETEEP

SEQ ID NO: 62 - protein, 12 aa, Homo sapiens
  C-terminal peptide cleaved from soluble rHuPH20 aa 431-442
DAFKLPPMETEE

SEQ ID NO: 63 - protein, 520 aa, Ovis aries
  PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
  PH20
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
  encoding sheep PH20
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter sp.
  hyaluronan lyase (strain FB24)
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae 18RS21
  hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae serotype Ia
  hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae serotype III
  hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus (strain COL); identical to SEQ ID NO: 33
  hyaluronan lyase

SEQ ID NO: 75 - protein, 420 aa, Staphylococcus aureus (strain MRSA252)
  hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus (strain MRSA252)
  hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus (strain MSSA476)
  hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus (strain NCTC 8325); identical to SEQ ID NO: 33
  hyaluronan lyase

SEQ ID NO: 79 - protein, 809 aa, Staphylococcus aureus (strain bovine RF122)
  hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus (strain bovine RF122)
  hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus (strain USA300); identical to SEQ ID NO: 33
  hyaluronan lyase

SEQ ID NO: 82 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae (strain ATCC BAA-255/R6)
  hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae serotype 2 (strain D39/N)
  hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes serotype M1
  hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes serotype M2 (strain MGAS10)
  hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes serotype M4 (strain MGAS10)
  hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes serotype M6
  hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes serotype M12 (strain MGAS2)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes serotype M12 (strain MGAS2)
  hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes serotype M12 (strain MGAS9)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes serotype M28
  hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri (strain ATCC 700601 / ES114)
  hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus sp. (strain RCC307)
  hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 684 aa, Pedobacter heparinus
  chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis ATCC BAA-548
  chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 102 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 103 - protein, 505 aa, Homo sapiens
  HuPH20 precursor 1-505
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 104 - protein, 503 aa, Homo sapiens
  HuPH20 precursor 1-503
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 105 - protein, 501 aa, Homo sapiens
  HuPH20 precursor 1-501
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 106 - protein, 499 aa, Homo sapiens
  HuPH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 107 - protein, 497 aa, Homo sapiens
  HuPH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 108 - protein, 495 aa, Homo sapiens
  HuPH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 109 - protein, 493 aa, Homo sapiens
  HuPH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 110 - protein, 491 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 111 - protein, 489 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 112 - protein, 490 aa, Homo sapiens
  HuPH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 113 - protein, 487 aa, Homo sapiens
  HuPH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 114 - protein, 485 aa, Homo sapiens
  HuPH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 115 - protein, 484 aa, Homo sapiens
  HuPH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 116 - protein, 476 aa, Homo sapiens
  HuPH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 117 - protein, 475 aa, Homo sapiens
  HuPH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 118 - protein, 474 aa, Homo sapiens
  HuPH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 119 - protein, 473 aa, Homo sapiens
  HuPH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 120 - protein, 472 aa, Homo sapiens
  HuPH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 121 - protein, 471 aa, Homo sapiens
  HuPH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 122 - protein, 470 aa, Homo sapiens
  HuPH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 123 - protein, 469 aa, Homo sapiens
  HuPH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 124 - protein, 468 aa, Homo sapiens
  HuPH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 125 - protein, 466 aa, Homo sapiens
  HuPH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 126 - protein, 465 aa, Homo sapiens
  HuPH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 127 - protein, 464 aa, Homo sapiens
  HuPH20 precursor 1-464
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 128 - protein, 462 aa, Homo sapiens
  HuPH20 precursor 1-462
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 129 - protein, 460 aa, Homo sapiens
  HuPH20 precursor 1-460
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 130 - protein, 458 aa, Homo sapiens
  HuPH20 precursor 1-458
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 131 - protein, 456 aa, Homo sapiens
  HuPH20 precursor 1-456
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 132 - protein, 454 aa, Homo sapiens
  HuPH20 precursor 1-454
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 133 - protein, 452 aa, Homo sapiens
  HuPH20 precursor 1-452
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 134 - protein, 450 aa, Homo sapiens
  HuPH20 precursor 1-450
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 135 - protein, 508 aa, Homo sapiens
  HuPH20 precursor 1-508
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 136 - protein, 506 aa, Homo sapiens
  HuPH20 precursor 1-506
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 137 - protein, 504 aa, Homo sapiens
  HuPH20 precursor 1-504
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 138 - protein, 502 aa, Homo sapiens
  HuPH20 precursor 1-502
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 139 - protein, 500 aa, Homo sapiens
  HuPH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 140 - protein, 498 aa, Homo sapiens
  HuPH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 141 - protein, 496 aa, Homo sapiens
  HuPH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 142 - protein, 494 aa, Homo sapiens
  HuPH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 143 - protein, 492 aa, Homo sapiens
  HuPH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 144 - protein, 488 aa, Homo sapiens
  HuPH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 145 - protein, 486 aa, Homo sapiens
  HuPH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 146 - protein, 472 aa, Homo sapiens
  mature HuPH20 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 147 - protein, 470 aa, Homo sapiens
  mature HuPH20 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 148 - protein, 468 aa, Homo sapiens
  mature HuPH20 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 149 - protein, 466 aa, Homo sapiens
  mature HuPH20 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 150 - protein, 464 aa, Homo sapiens
  mature HuPH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 151 - protein, 462 aa, Homo sapiens
  esHuPH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 152 - protein, 460 aa, Homo sapiens
  esHuPH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 153 - protein, 458 aa, Homo sapiens
  esHuPH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 154 - protein, 456 aa, Homo sapiens
  esHuPH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 155 - protein, 454 aa, Homo sapiens
  mature HuPH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 156 - protein, 455 aa, Homo sapiens
  mature HuPH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 157 - protein, 452 aa, Homo sapiens
  mature HuPH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 158 - protein, 450 aa, Homo sapiens
  Mature HuPH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 159 - protein, 449 aa, Homo sapiens
  Mature HuPH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 160 - protein, 441 aa, Homo sapiens
  Mature HuPH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 161 - protein, 440 aa, Homo sapiens
  Mature HuPH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 162 - protein, 439 aa, Homo sapiens
  Mature HuPH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 163 - protein, 438 aa, Homo sapiens
  Mature HuPH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 164 - protein, 437 aa, Homo sapiens
  Mature HuPH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 165 - protein, 436 aa, Homo sapiens
  Mature HuPH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 166 - protein, 435 aa, Homo sapiens
  Mature HuPH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 167 - protein, 434 aa, Homo sapiens
  Mature HuPH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 168 - protein, 433 aa, Homo sapiens
  Mature HuPH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 169 - protein, 431 aa, Homo sapiens
  Mature HuPH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 170 - protein, 430 aa, Homo sapiens
  Mature HuPH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 171 - protein, 429 aa, Homo sapiens
  Mature HuPH20 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 172 - protein, 427 aa, Homo sapiens
  Mature HuPH20 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 173 - protein, 425 aa, Homo sapiens
  Mature HuPH20 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 174 - protein, 423 aa, Homo sapiens
  Mature HuPH20 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 175 - protein, 421 aa, Homo sapiens
  Mature HuPH20 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 176 - protein, 419 aa, Homo sapiens
  Mature HuPH20 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 177 - protein, 417 aa, Homo sapiens
  Mature HuPH20 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 178 - protein, 415 aa, Homo sapiens
  Mature HuPH20 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 179 - protein, 473 aa, Homo sapiens
  Mature HuPH20 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 180 - protein, 471 aa, Homo sapiens
  Mature HuPH20 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 181 - protein, 469 aa, Homo sapiens
  Mature HuPH20 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 182 - protein, 467 aa, Homo sapiens
  Mature HuPH20 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 183 - protein, 465 aa, Homo sapiens
  Mature HuPH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 184 - protein, 463 aa, Homo sapiens
  Mature HuPH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 185 - protein, 461 aa, Homo sapiens
  esHuPH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 186 - protein, 459 aa, Homo sapiens
  esHuPH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 187 - protein, 457 aa, Homo sapiens
  esHuPH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 188 - protein, 453 aa, Homo sapiens
  Mature HuPH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 189 - protein, 451 aa, Homo sapiens
  Mature HuPH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

What is claimed:

1. A multivesicular liposome, comprising:
   a) a neutral lipid;
   an amphipathic lipid; and
   a hyaluronan-degrading enzyme, wherein the concentration of the hyaluronan-degrading enzyme is between or about between 0.1 mg/mL to 1 mg/mL; or
   b) a neutral lipid;
   an amphipathic lipid;
   a hyaluronan-degrading enzyme; and
   hyaluronic acid in an amount sufficient to increase the enzymatic activity of the hyaluronan-degrading enzyme.

2. The multivesicular liposome of claim 1, wherein the multivesicular liposome is of a) and further comprises hyaluronic acid in an amount sufficient to increase the enzymatic activity of the hyaluronan-degrading enzyme.

3. The multivesicular liposome of claim 1, wherein the hyaluronic acid maintains the total activity of the enzyme of at least 40,000 U/mg.

4. The multivesicular liposome of claim 2, wherein the hyaluronic acid maintains the total activity of the enzyme of at least 40,000 U/mg.

5. The multivesicular liposome of claim 1, wherein the hyaluronan-degrading enzyme is a hyaluronidase, a chondroitinase or a lyase.

6. The multivesicular liposome of claim 5, wherein the hyaluronan-degrading enzyme is a hyaluronidase that is a PH20 hyaluronidase.

7. The multivesicular liposome of claim 6, wherein the PH20 is soluble or is a form that is secreted when expressed.

8. The multivesicular liposome of claim 7, wherein the soluble PH20 is selected from among polypeptides containing the sequence of amino acids set forth in any of SEQ ID NOS: 4-9, 47 and 48, or a sequence of amino acids that exhibits at least 91% sequence identity to any of SEQ ID NOS: 4-9, 47 and 48 and is soluble and exhibits hyaluronidase activity.

9. A multivesicular liposome, comprising:
a) a neutral lipid;
an amphipathic lipid; and
a hyaluronan-degrading enzyme, wherein the concentration of the hyaluronan-degrading enzyme is between or about between 0.1 mg/mL to 1 mg/mL; or
b) a neutral lipid;
an amphipathic lipid;
a hyaluronan-degrading enzyme; and
hyaluronic acid in an amount sufficient to increase the enzymatic activity of the hyaluronan-degrading enzyme, wherein the hyaluronan-degrading enzyme is modified by conjugation to a polymer.

10. The multivesicular liposome of claim 9, wherein the polymer is PEG or dextran.

11. The multivesicular liposome of claim 1, wherein the concentration of hyaluronic acid is or is about between 0.05 mg/mL to 50 mg/mL.

12. The multivesicular liposome of claim 2, wherein the concentration of hyaluronic acid is or is about between 0.05 mg/mL to 50 mg/mL.

13. The multivesicular liposome of claim 1, wherein the neutral lipid is a diglyceride or a triglyceride.

14. The multivesicular liposome of claim 13, wherein the neutral lipid is a triglyceride that is triolein or tricaprylin, or a mixture of triolein and tricaprylin.

15. The multivesicular liposome of claim 14, wherein triolein and tricaprylin are in a 50:50 (1:1) molar ratio.

16. The multivesicular liposome of claim 1, wherein the amphipathic lipid is a phosphatidylglycerol (PG), cardiolipin (CL), phosphatidylserine (PS), phosphatidic acid (PA), phosphatidylinositol, phosphatidylcholine (PC), phosphatidylethanolamine (PE), sphingomyelin, or diacyl trimethylammonium propane (DITAP).

17. The multivesicular liposome of claim 16, wherein the amphipathic lipid is a phosphatidylcholine that is DEPC or DOPC, or a mixture of DEPC and DOPC.

18. The multivesicular liposome of claim 17, wherein DEPC and DOPC are in a molar ratio that is at least or about at least 50:50 (1 DEPC:1 DOPC), 75:25 (3 DEPC:1 DOPC) or 90:10 (9 DEPC:1 DOPC).

19. The multivesicular liposome of claim 1, further comprising dipalmitoyl-L-alpha-phosphatidylglycerol (DPPG).

20. The multivesicular liposome of claim 1, further comprising cholesterol.

21. The multivesicular liposome of claim 1, further comprising a therapeutic agent.

22. The multivesicular liposome of claim 21, wherein the therapeutic agent is hydrophobic.

23. The multivesicular liposome of claim 21, wherein the therapeutic agent is an agent to treat benign prostatic hyperplasia.

24. The multivesicular liposome of claim 21, wherein the therapeutic agent is selected from among an anti-androgen, an alpha blocker, a *boutlinum* toxin and a hydrolytic enzyme.

25. The multivesicular liposome of claim 24, wherein the anti-androgen is a steroid anti-androgen, a non-steroid anti-androgen or a 5α-reductase inhibitor.

26. The multivesicular liposome of claim 25, wherein the agent is a 5α-reductase inhibitor that is finasteride or dutasteride.

27. A composition, comprising a multivesicular liposome of claim 1 in a pharmaceutically acceptable carrier.

28. The composition of claim 27, comprising NaCl.

29. The composition of claim 28, wherein the concentration of NaCl is between or about between 100 mM to 150 mM.

30. The composition of claim 27, comprising histidine.

31. The composition of claim 30, wherein the concentration of histidine is between or about between 1 mM to 100 mM.

32. The composition of claim 27, wherein the pH of the composition is or is about between 6.0 to 8.0.

33. The composition of claim 27, comprising a therapeutic agent.

34. The composition of claim 33, wherein the therapeutic agent is an agent for treating benign prostatic hyperplasia.

35. The composition of claim 34, wherein the therapeutic agent is selected from among an anti-androgen, an alpha blocker, a *boutlinum* toxin, and a hydrolytic enzyme.

36. The composition of claim 35, wherein the anti-androgen is a steroid anti-androgen, a non-steroid anti-androgen or a 5α-reductase inhibitor.

37. The composition of claim 36, wherein the therapeutic agent is a 5α-reductase inhibitor that is finasteride or dutasteride.

38. A combination, comprising:
a first composition comprising a composition of claim 27; and
a second composition comprising a therapeutic agent.

39. The combination of claim 38, wherein the therapeutic agent is an agent for treating benign prostatic hyperplasia.

40. The combination of claim 38, wherein the therapeutic agent is selected from among an anti-androgen, an alpha blocker, a *boutlinum* toxin, and a hydrolytic enzyme.

41. The combination of claim 40, wherein the anti-androgen is a steroid anti-androgen, a non-steroid anti-androgen or a 5α-reductase inhibitor.

42. The combination of claim 41, wherein the therapeutic agent is a 5α-reductase inhibitor that is finasteride or dutasteride.

43. A composition, comprising:
a hyaluronan-degrading enzyme, wherein the concentration of the hyaluronan-degrading enzyme is at least 50 U/mL; and
hyaluronic acid, whereby the hyaluronan-degrading enzyme retains at least 50% of the hyaluronidase activity for at least six months at 28° C. to 32° C. or at least one year at 2° C. to 8° C.

44. The composition of claim 43 that is a pharmaceutical composition.

45. The composition of claim 43 that is formulated for direct administration.

46. The composition of claim 43, wherein the hyaluronan-degrading enzyme is a hyaluronidase, a chondroitinase or a lyase.

47. The composition of claim 46, wherein the hyaluronan-degrading enzyme is a hyaluronidase that is a PH20 hyaluronidase.

48. The composition of claim 47, wherein the PH20 is soluble or is a form that is secreted when expressed.

49. The composition of claim 48, wherein the PH20 is selected from among polypeptides containing the sequence of amino acids set forth in any of SEQ ID NOS: 4-9, 47 and 48, or a sequence of amino acids that has at least 91% sequence identity to any of SEQ ID NOS:4-9, 47 and 48 and is soluble and exhibits hyaluronidase activity.

50. The composition of claim 43, wherein the hyaluronan-degrading enzyme is modified by conjugation to a polymer.

51. The composition of claim 50, wherein the polymer is PEG or dextran.

52. The composition of claim 43, wherein the concentration of the hyaluronan-degrading enzyme is or is about between or at least 100 U/mL to 1000 U/mL.

53. The composition of claim 43, wherein the concentration of hyaluronic acid is or is about between 1 mg/mL to 100 mg/mL.

54. The composition of claim 43, wherein the composition is formulated as a single or multiple dosage formulation for direct administration.

55. The composition of claim 43, wherein the composition is formulated in a volume per administration of between or about 0.5 mL to 50 mL.

56. The composition of claim 43, further comprising NaCl.

57. The composition of claim 56, wherein the concentration of NaCl is between or about between 100 mM to 150 mM.

58. The composition of claim 43, further comprising histidine.

59. The composition of claim 58, wherein the concentration of histidine is between or about between 1 mM to 100 mM.

60. The composition of claim 43, wherein the pH of the composition is or is about between 6.0 to 8.0 or 6.5 to 7.5 or is at least or about or 6.0, 6.5, 7.0 or 7.4.

61. A method of treating a hyaluronan associated disease or condition, comprising administering to a subject a composition of claim 27.

62. The method of claim 61, wherein the hyaluronan associated disease or condition is benign prostatic hyperplasia.

63. The method of claim 61, wherein the composition is administered to the subject intraprostaticaly.

64. The method of claim 61, further comprising administering another agent to treat benign prostatic hyperplasia.

65. The method of claim 64, wherein the other agent is selected from among an anti-androgen, an alpha blocker, a *boutlinum* toxin and a hydrolytic enzyme.

66. The method of claim 65, wherein the anti-androgen is a steroid anti-androgen, a non-steroid anti-androgen or a 5α-reductase inhibitor.

67. The method of claim 66, wherein the agent is a 5α-reductase inhibitor that is finasteride or dutasteride.

68. The multivesicular liposome of claim 1, wherein the hyaluronan-degrading enzyme is encapsulated in the liposome.

69. A multivesicular liposome, comprising:
   a neutral lipid;
   an amphipathic lipid; and
   a hyaluronan-degrading enzyme, wherein the concentration of the hyaluronan-degrading enzyme is between or about between 0.1 mg/mL to 1 mg/mL.

70. The multivesicular liposome of claim 1, wherein the hyaluronan-degrading enzyme is linked, directly to indirectly, to a label or detectable moiety.

71. A multivesicular liposome, made by a process or obtainable by a process comprising the steps of:
   a) forming a first aqueous component comprising a hyaluronan degrading enzyme in a concentration less than 2 mg/mL;
   b) forming a lipid component comprising at least one organic solvent, at least one amphiphatic lipid and at least one neutral lipid;
   c) forming an emulsion from the first aqueous component and the lipid component;
   d) dispersing the emulsion into a second aqueous component to form solvent spherules; and
   e) removing the organic solvent from the solvent spherules to form multivesicular liposomes suspended in the second aqueous component.

72. The multivesicular liposome of claim 71, wherein the hyaluronan-degrading enzyme is in a concentration of between or about between 0.1 mg/mL to 1.9.

* * * * *